United States Patent
Baltes et al.

(10) Patent No.: US 12,012,607 B2
(45) Date of Patent: Jun. 18, 2024

(54) ENGINEERING WHEAT WITH INCREASED DIETARY FIBER

(71) Applicant: CELLECTIS, Paris (FR)

(72) Inventors: Nicholas Baltes, Maple Grove, MN (US); Javier Gil Humanes, Circle Pines, MN (US)

(73) Assignee: Cellectis, Paris (FR)

( * ) Notice: Subject to any disclaimer, the term of this patent is extended or adjusted under 35 U.S.C. 154(b) by 62 days.

(21) Appl. No.: 17/052,351

(22) PCT Filed: May 2, 2019

(86) PCT No.: PCT/IB2019/053610
§ 371 (c)(1),
(2) Date: Nov. 2, 2020

(87) PCT Pub. No.: WO2019/211796
PCT Pub. Date: Nov. 7, 2019

(65) Prior Publication Data
US 2021/0079412 A1 Mar. 18, 2021

Related U.S. Application Data

(60) Provisional application No. 62/665,643, filed on May 2, 2018.

(51) Int. Cl.
*C12N 15/82* (2006.01)
*C12N 9/16* (2006.01)

(52) U.S. Cl.
CPC .......... *C12N 15/8245* (2013.01); *C12N 9/16* (2013.01); *C12N 15/8262* (2013.01)

(58) Field of Classification Search
None
See application file for complete search history.

(56) References Cited

U.S. PATENT DOCUMENTS 7,812,221 B2 * 10/2010 Regina .................. A23L 29/212
800/278
9,060,533 B2 * 6/2015 Regina ............... C12N 15/8245
9,150,839 B2 * 10/2015 Slade ................. C12N 15/8245
9,834,776 B2 * 12/2017 Boerjan .................... C12N 9/16
2012/0114770 A1 5/2012 Regina et al.
2013/0090462 A1 4/2013 Slade et al.

FOREIGN PATENT DOCUMENTS

| JP | 2015504301 A | 2/2015 |
| JP | 2016514480 A | 5/2016 |
| WO | 2005/001098 A1 | 1/2005 |
| WO | 2013063653 A1 | 5/2013 |
| WO | 2014/165612 A2 | 10/2014 |

OTHER PUBLICATIONS

Botticella et al, 2011, BMC Plant Biology, 11:1-14.*
Wang et al, 2014, Nature Biotechnology, 32:947-952.*
Khan, et al., "Use of TALEs and TALEN Technology for Genetic Improvement of Plants", Springer Science+Business Media, New York, Aug. 11, 2016.
"International Search Report and Written Opinion for PCT/IB2019/053610,", dated Nov. 7, 2019.
Gaj, et al., "ZFN, TALEN, and CRISPR/Cas-based methods for genome engineering", NIH Public Access Author Manuscript, vol. 31. No. 7, May 9, 2013 (May 9, 2013), pp. 1-20, XP55465031, DOI: 10.1016/j.tibtech.2013.04.004 the whole document.
Japanese Final Office Action dated Jun. 7, 2022, for corresponding Japanese patent application No. P2020-561705.
Malahn et al., "Plant genome editing with TALEN and CRISPR," Cell Biosci. 7:21 (Apr. 24, 2017).
Canadian Office Action dated Nov. 18, 2022, for corresponding Canadian patent application No. 3,099,102.
Chinese Office Action dated May 8, 2023, for corresponding Chinese patent application No. 201980042136X.
Botticella et al., "Triticum aestivum sbeiia ene fot starch branching enzyme IIa", EMBL, HE591389 (Aug. 22, 2012).

* cited by examiner

*Primary Examiner* — Jason Deveau Rosen
(74) *Attorney, Agent, or Firm* — Dicke, Billig & Czaja, PLLC

(57) ABSTRACT

Materials and methods are provided for making plants (e.g., *Triticum* varieties) with increased levels of dietary fiber, such as by making TALE nuclease-induced mutations in alleles encoding starch branching enzyme IIa (SBEIIa) and starch branching enzyme IIb (SBEIIb).

29 Claims, 14 Drawing Sheets

Specification includes a Sequence Listing.

FIG. 1

>SBEIIa-A Exon 2
GCGCCGTCCTGAGCCGCCGCGGCCTCTCCAGGAAGGTCCTGGTGCCTGACGGTGAGAGCGACGACTTGGCAAGTC
CGGCGCAACCTGAAGAATTACAG (SEQ ID NO:11890)

>SBEIIa-A Exon 3
ATACCTGAAGACATCGAGGAGCAAACGGCTGAAGTAAACATGACAGGGGGACTGCAGAAAAACTTGAATCTTCAGA
ACCGACTCAAGGCATTGTGAAACAATCACTGATGGTGTAACCAAAGGAGTTAAGGAACTAGTCGTGGGGGAGAAAC
CGCGAGTTGTCCCAAAACCAGGAGATGGGCAGAGAATATACGAGATTGACCCAACGCTGAAAGATTTTCGGAGCCAT
CTTGACTACCG (SEQ ID NO:11891)

>SBEIIa-B Exon 2
GCGCCGTCCTGAGCCGCCGCGGCCTCTCCAGGAAGGTCCTGGTGCCTGACGGTGAGAGCGACGACTTGGCGGGCCA
CTCCAGCGCAACCCGAAGAATTACAG (SEQ ID NO:11892)

>SBEIIa-B Exon 3
ATACCTGAAGATATCGAGGAGCAAACGGCTGAAGTGAACATGACAGGGGGACTGCAGAGAAACTTCAATATTCAGA
ACCGACTCAGGGCATTGTGAAACAATCACTGATGGTGTAACCAAAGGAGTTAAGGAACTAGTCGTGGGGGAGAAAC
CGCGAGTTGTCCCAAAACCAGGAGATGGGCAGAGAATATACGAGATTGACCCAACGCTGAAAGATTTTCGGAGCCAT
CTTGACTACCG (SEQ ID NO:11893)

>SBEIIa-D Exon 2
GCGCCGTCCTGAGCCGCCGCGGCCTCTCCAGGAAGGTCCTGGTGCCTGACGGTGAGAGCGACGACTTGGCAAGTC
CGGCGCAACCTGAAGAATTACAG (SEQ ID NO:11894)

>SBEIIa-D Exon 3
ATACCTGAAGATATCGAGGAGCAAACGGCGGAAGTGAACATGACAGGGGGACTGCAGAGAAACTTCAATCTTCAGA
ACCGACTCAGGGCATTGTGAAACAATCACTGATGGTGTAACCAAAGGAGTTAAGGAACTAGTCGTGGGGGAGAAAC
CGCGAGTTGTCCCAAAACCAGGAGATGGGCAGAAAATATACGAGATTGACCCAACACTGAAAGATTTTCGGAGCCAT
CTTGACTACCG (SEQ ID NO:11895)

SBEIIa_T1

SBEIIa-A: TATACGAGATTGACCCAAACGCTGAAAGATTTTCGGAGCCATCTTGACTA (SEQ ID NO:11896)
SBEIIa-B: TATACGAGATTGACCCAAACGCTGAAAGATTTTCGGAGCCATCTTGACTA (SEQ ID NO:11896)
SBEIIa-D: TATACGAGATTGACCCAACaCTGAAAGATTTTCGGAGCCATCTTGACTA (SEQ ID NO:11897)

SBEIIa_T2

SBEIIa-A: TTCAGAACCGACTCAaGGCATTGTGGAAACAATCACTGATGGTGTAACCA (SEQ ID NO:11898)
SBEIIa-B: TTCAGAACCGACTCAGGGCATTGTGGAAACAATCACTGATGGTGTAACCA (SEQ

FIG. 4

Plant Ta125-2

SBEIIa-A

WT:  GTCATCCTTGCATTGCAGGCGCCGTCCTGAGCCGGCGGCCTCTCCAGGG--AAGTCCTGGTGCCTGAC
     GGTGAGAGCGACGACTTGGCAAGTCCGGCGCA (SEQ ID NO:11908)

+2:  GTCATCCTTGCATTGCAGGCGCCGTCCTGAGCCGGCGGCCTCTCCAGGGgAAGGTCCTGGTGCCTGAC
     GGTGAGAGCGACGACTTGGCAAGTCCGGCGCA (SEQ ID NO:11909)

-23: GTCATCCTTGCATTGCAGGCGCCGTCCTGAGCCGGCCT-----------------GAC
     GGTGAGAGCGACGACTTGGCAAGTCCGGCGCA (SEQ ID NO:11910)

SBEIIa-B

WT:  CTCATCCTTGCATTTGCAGGCGCCGTCCTGAGCCGGCGGCCTCTCCAGGGAAGGTCCTGGTGCCTGACG
     GTGAGAGCGACGACTTGGGCGGCCACTCCAGCGCA (SEQ ID NO:11911)

-4:  CTCATCCTTGCATTTGCAGGCGCCGTCCTGAGCCGGCGGCCTCTCCA----AGGTCCTGGTGCCTGACG
     GTGAGAGCGACGACTTGGGCGGCCACTCCAGCGCA (SEQ ID NO:11912)

-20: CTCATCCTTGCATTTGCAGGCGCCGTCCTGAGCCGGCGGC--------------------TGCCTGACG
     GTGAGAGCGACGACTTGGGCGGCCACTCCAGCGCA (SEQ ID NO:11913)

SBEIIa-D

WT:  GTCATCCTTGCATTTGCAGGCGCCGCCGTCCTGAGCCGGCCTCTCCAGGGAAGTCCTGGTGCCTGAC
     GGCGAGAGCGACGACTTGGCAAGTCCGGCGCA (SEQ ID NO:11914)

-4:  GTCATCCTTGCATTTGCAGGCGCCGCCGTCCTGAGCCGGCCTCTCCA----AGGTCCTGGTGCCTGAC
     GGCGAGAGCGACGACTTGGCAAGTCCGGCGCA (SEQ ID NO:11915)

-12: GTCATCCTTGCATTTGCAGGCGCCGCCGTCCTGAGCCGGCC------------GTCCTGGTGCCTGAC
     GGCGAGAGCGACGACTTGGCAAGTCCGGCGCA (SEQ ID NO:11916)

FIG. 5

Plant Ta128-1

SBEIIa-A

WT: GTCATCCTTGCATTGCAGGCGCCGTTCCTGAGCCGGCCGTCCTGGTGCCTGACGG
TGAGAGCGACGACTTGGCAAGTCCGGCGCA (SEQ ID NO:11908)

SBEIIa-B

WT: CTCATCCTTGCATTTGCAGGCGCGCCGTTCCTGAGCCGGCCGTCCTGGTGCCTGAC
GGTGAGAGCGACGACTTGGCGGCCACTCCAGCGCA (SEQ ID NO:11911)

+1: CTCATCCTTGCATTTGCAGGCGCGCCGTCCTGAGCCGGCCGCTCTCCAgGGGAAGGTCCTGGTGCCTGAC
GGTGAGAGCGACGACTTGGCGGCCACTCCAGCGCA (SEQ ID NO:11917)

-1: CTCATCCTTGCATTTGCAGGCGCGCCGTCCTGAGCCGGCCGCTCTCCA---GGAAGGTCCTGGTGCCTGAC
GGTGAGAGCGACGACTTGGCGGCCACTCCAGCGCA (SEQ ID NO:11918)

SBEIIa-D

WT: GTCATCCTTGCATTTGCAGGCGCCGTCCTGAGCCGGCCGCCTCTCCAGGGAAGGTCCTGGTGCCTG
ACGGCGAGAGCGACGACTTGGCAAGTCCGGGCGCA (SEQ ID NO:11914)

-21: GTCATCCTTGCATTTGCAGGCGCCGTCCTGAGCCGGC-------------GCCTG
ACGGCGAGAGCGACGACTTGGCAAGTCCGGGCGCA (SEQ ID NO:11919)

-890: TCATCCTTGCATTTTGCAGGCGCC---//----TTCCTAGGGGGAAATC (SEQ ID NO:11920)

FIG. 6A

Plant Ta137-1

SBEIIa-A

```
WT:    GTCATCCTTGCTTGCATTGCAGGCGCCGTCCTGAGCCGCGGCCCTCTCCAGGAAGGTCCTGGTGCCTGACGG
       TGAGAGCGACGACTTGGCAAGTCCGGCGCA (SEQ ID NO:11908)

-4:    GTCATCCTTGCATTGCAGGCGCCGTCCTGAGCCGCGGCCCTCTCCAG----GGTCCTGGTGCCTGACGG
       TGAGAGCGACGACTTGGCAAGTCCGGCGCA (SEQ ID NO:11921)

-7:    GTCATCCTTGCATTGCAGGCGCCGTCCTGAGCCGCGGCCCTCTCC-------GTCCTGGTGCCTGACGG
       TGAGAGCGACGACTTGGCAAGTCCGGCGCA (SEQ ID NO:11922)

-13:   GTCATCCTTGCATTGCAGGCGCCGTCCTGAGCCGCGGCCC-------------TCCTGGTGCCTGACGG
       TGAGAGCGACGACTTGGCAAGTCCGGCGCA (SEQ ID NO:11923)

-167:  TTTTCTCACTCTTTCTTCTGTGTTCTTGCTGTAACTGCAAGTT--//--GTACACACCATCGTGCCGGGAA
       ATCTTCATACAATCG (SEQ ID NO:11924)
```

SBEIIa-B

```
WT:    CTCATCCTTGCATTGCAGGCGCCGTCCTGAGCCGCGGCCCTCTCCAGGAAGGTCCTGGTGCCTGAC
       GGTGAGAGCGACGACTTGGCGGCCACTCCAGCGCA (SEQ ID NO:11911)

-17:   CTCATCCTTGCATTGCAGGCGCCGTCCTGAGCCG-------------AGGTCCTGGTGCCTGAC
       GGTGAGAGCGACGACTTGGCGGCCACTCCAGCGCA (SEQ ID NO:11925)
```

Plant Ta137-1
SBEIIa-D

WT:   GTCATCCTTGCATTTTGCAGGCGCCGTCCTGAGCCGCGGCGCCTCTCCAGGGAAGGTCCTGGTGCCTGA
      CGGCGAGAGCGACGACTTGGCAAGTCCGGGCGCA (SEQ ID NO:11914)

-6:   GTCATCCTTGCATTTTGCAGGCGCCGTCCTGAGCCGCGGCGCCTCTCCAG------TCCTGGTGCCTGA
      CGGCGAGAGCGACGACTTGGCAAGTCCGGGCGCA (SEQ ID NO:11926)

-10:  GTCATCCTTGCATTTTGCAGGCGCCGTCCTGAGCCGCGGCGCCTCTC----------GTCCTGGTGCCTGA
      CGGCGAGAGCGACGACTTGGCAAGTCCGGGCGCA (SEQ ID NO:11927)

-13:  GTCATCCTTGCATTTTGCAGGCGCCGTCCTGAGCCGCGGCGCCTCC-------------GTGCCTGA
      CGGCGAGAGCGACGACTTGGCAAGTCCGGGCGCA (SEQ ID NO:11928)

-14:  GTCATCCTTGCATTTTGCAGGCGCCGTCCTGAGCCGCGGCGCCT--------------CTGGTGCCTGA
      CGGCGAGAGCGACGACTTGGCAAGTCCGGGCGCA (SEQ ID NO:11929)

-15:  GTCATCCTTGCATTTTGCAGGCGCCGTCCTGAGCCGCGC---------------GGTCCTGGTGCCTGA
      CGGCGAGAGCGACGACTTGGCAAGTCCGGGCGCA (SEQ ID NO:11930)

Plant Ta139-1
SBEIIa-A
WT: GTCATCCTTGCATTGCAGGCGCCGTCCTGAGCCGGCGGCT CTCCAGGAAGGTCCTGGTGCCTGACGG
TGAGAGCGACGACTTGGCAAGTCCGGCGCA (SEQ ID NO:11908)

-4: GTCATCCTTGCATTGCAGGCGCCGTCCTGAGCCGGCGGCTCTC----AAGGTCCTGGTGCCTGACGG
TGAGAGCGACGACTTGGCAAGTCCGGCGCA (SEQ ID NO:11931)

SBEIIa-B
WT: CTCATCCTTGCATTGCAGGCGCCGTCCTGAGCCGGCGGCCTCTCCAGGAAGGTCCTGGTGCCTGAC
GGTGAGAGCGACGACTTGGCGGCCACTCCAGCGCA (SEQ ID NO:11911)

-4: CTCATCCTTGCATTGCAGGCGCCGTCCTGAGCCGGCCTCTCCAGG----TCCTGGTGCCTGAC
GGTGAGAGCGACGACTTGGCGGCCACTCCAGCGCA (SEQ ID NO:11932)

-10: CTCATCCTTGCATTGCAGGCGCCGTCCTGAGCCGGCGGCCTC----------CCTGGTGCCTGAC
GGTGAGAGCGACGACTTGGCGGCCACTCCAGCGCA (SEQ ID NO:11933)

-22: CTCATCCTTGCATTGCAGGCGCCGTCCTGAGCCGGCGGCCTCT---------------------AC
GGTGAGAGCGACGACTTGGCGGCCACTCCAGCGCA (SEQ ID NO:11934)

SBEIIa-D
WT: GTCATCCTTGCATTTGCAGGCGCCGTCCTGAGCCGGCGGCCT CTCCAGGAAGGTCCTGGTGCCTGA
CGGCGAGAGCGACGACTTGGCAAGTCCGGGCGCA (SEQ ID NO:11914)

-11: GTCATCCTTGCATTTGCAGGCGCCGTCCTGAGCCGGCGCCTCTCC--------TGGTGCCTGA
CGGCGAGAGCGACGACTTGGCAAGTCCGGGCGCA (SEQ ID NO:11935)

-17: GTCATCCTTGCATTTGCAGGCGCCGTCCTGAGCCGGCGGC----------------TGGTGCCTGA
CGGCGAGAGCGACGACTTGGCAAGTCCGGGCGCA (SEQ ID NO:11936)

FIG. 8

Plant Ta125-2-14

SBEIIa-A

-23: GTCATCCTTGCATTGCAGGCGCCGTCCTGAGCCGCGGCCT------------------G
ACGGTGAGAGCGACGACTTGGCAAGTCCGGCGCA (SEQ ID NO:11910)

-23: GTCATCCTTGCATTGCAGGCGCCGTCCTGAGCCGCGGCCT------------------G
ACGGTGAGAGCGACGACTTGGCAAGTCCGGCGCA (SEQ ID NO:11910)

SBEIIa-B

-4: CTCATCCTTGCATTTGCAGGCGCCGTCCTGAGCCGCGGCCTCTCCA----AGGTCCTGGTGCCTGAC
GGTGAGAGCGACGACTTGGCGGCCACTCCAGCGCA (SEQ ID NO:11912)

-4: CTCATCCTTGCATTTGCAGGCGCCGTCCTGAGCCGCGGCCTCTCCA----AGGTCCTGGTGCCTGAC
GGTGAGAGCGACGACTTGGCGGCCACTCCAGCGCA (SEQ ID NO:11912)

SBEIIa-D

-12: GTCATCCTTGCATTTGCAGGCGCCGTCCTGAGCCGCGGCC----------GTCCTGGTGCCTG
ACGGCGAGAGCGACGACTTGGCAAGTCCGGCGCA (SEQ ID NO:11916)

-12: GTCATCCTTGCATTTGCAGGCGCCGTCCTGAGCCGCGGCC----------GTCCTGGTGCCTG
ACGGCGAGAGCGACGACTTGGCAAGTCCGGCGCA (SEQ ID NO:11916)

FIG. 9

Plant Ta125-2-44-1-1a (-23/-23, -4/-4, -4/-4)

SBEIIa-A

-23: GTCATCCTTGCATTGCAGGCGCCGTCCTGAGCCGCGGCCT----------------G
ACGGTGAGAGCGACGAGCTTGGCAAGTCCGGCGCA (SEQ ID NO:11910)

-23: GTCATCCTTGCATTGCAGGCGCCGTCCTGAGCCGCGGCCT----------------G
ACGGTGAGAGCGACGAGCTTGGCAAGTCCGGCGCA (SEQ ID NO:11910)

SBEIIa-B

-4: CTCATCCTTGCATTTGCAGGCGCCGTCCTGAGCCGGCCTCTCCA----AGGTCCTGGTGCCTGAC
GGTGAGAGCGACGACTTGGCGGCCACTCCAGCGCA (SEQ ID NO:11912)

-4: CTCATCCTTGCATTTGCAGGCGCCGTCCTGAGCCGGCCTCTCCA----AGGTCCTGGTGCCTGAC
GGTGAGAGCGACGACTTGGCGGCCACTCCAGCGCA (SEQ ID NO:11912)

SBEIIa-D

-4: GTCATCCTTGCATTTGCAGGCGCCGTCCTGAGCCGGCCTCTCCA----AGGTCCTGGTGCCTGA
CGGCGAGAGCGACGACTTGGCAAGTCCGGCGCA (SEQ ID NO:11915)

-4: GTCATCCTTGCATTTGCAGGCGCCGTCCTGAGCCGGCCTCTCCA----AGGTCCTGGTGCCTGA
CGGCGAGAGCGACGACTTGGCAAGTCCGGCGCA (SEQ ID NO:11915)

FIG. 10

Plant Ta125-2-44-1-2a (-23/-23, -20/-20, -4/-4)

SBEIIa-A

-23: GTCATCCTTGCATTGCAGGCGCCGTCCTGAGCCGCGCGGGCCT---------------------------GA
CGGTGAGAGCGACGACTTGGCAAGTCCGGCGCA (SEQ ID NO:11910)

-23: GTCATCCTTGCATTGCAGGCGCCGTCCTGAGCCGCGCGGGCCT---------------------------GA
CGGTGAGAGCGACGACTTGGCAAGTCCGGCGCA (SEQ ID NO:11910)

SBEIIa-B

-20: CTCATCCTTGCATTTGCAGGCGCGTCCTGAGCCGCGGC----------------------TGCCTGAC
GGTGAGAGCGACGACTTGGCGGCCACTCCAGCGCA (SEQ ID NO:11913)

-20: CTCATCCTTGCATTTGCAGGCGCGTCCTGAGCCGCGGC----------------------TGCCTGAC
GGTGAGAGCGACGACTTGGCGGCCACTCCAGCGCA (SEQ ID NO:11913)

SBEIIa-D

-4: GTCATCCTTGCATTTTGCAGGCGCCGTCCTGAGCCGCGGCCTCTCCA----AGGTCCTGGTGCCTGAC
GGCGAGAGCGACGACTTGGCAAGTCCGGCGCA (SEQ ID NO:11915)

-4: GTCATCCTTGCATTTTGCAGGCGCCGTCCTGAGCCGCGGCCTCTCCA----AGGTCCTGGTGCCTGAC
GGCGAGAGCGACGACTTGGCAAGTCCGGCGCA (SEQ ID NO:11915)

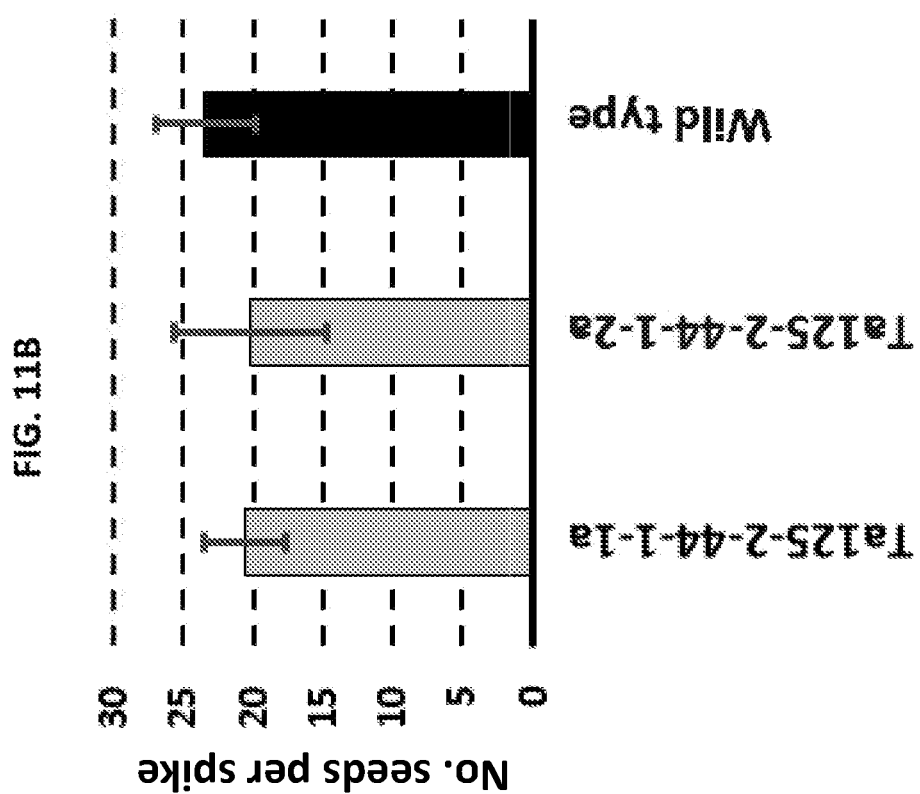

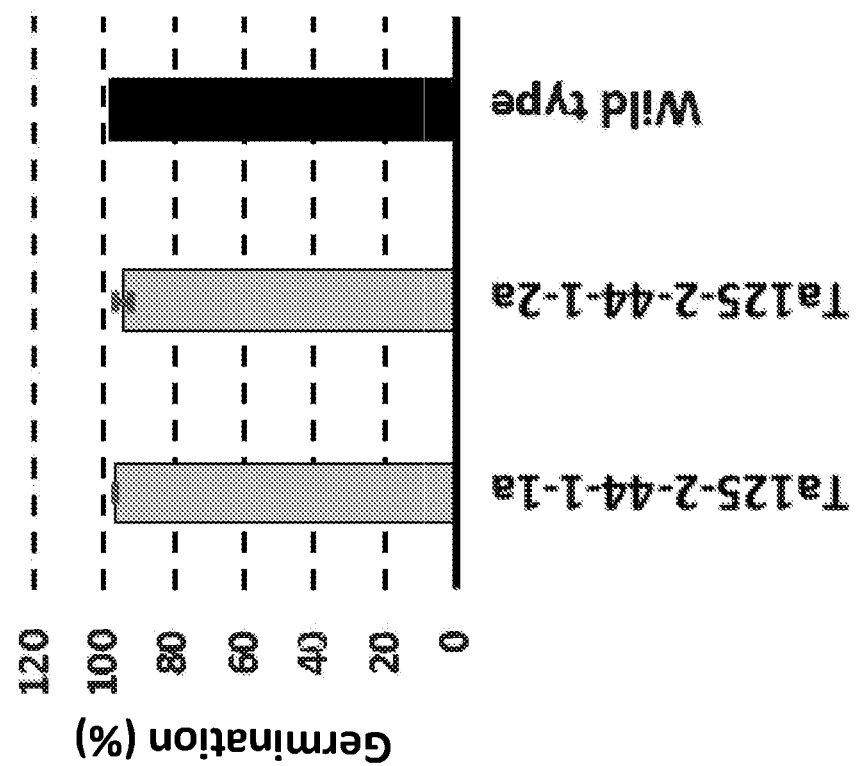

ENGINEERING WHEAT WITH INCREASED DIETARY FIBER

CROSS-REFERENCE TO RELATED APPLICATIONS

This application claims benefit of priority from U.S. Provisional Application Ser. No. 62/665,643, filed May 2, 2018.

SEQUENCE LISTING

The instant application contains a Sequence Listing which has been submitted electronically via EFS-Web in ASCII format. The ASCII copy, created on May 6, 2022, is named C1633148101_SequenceListing_substitute.txt and is 8,836 kb in size.

TECHNICAL FIELD

This document provides materials and methods for generating wheat varieties with increased amylose content.

BACKGROUND

Wheat (*Triticum aestivum*) is one of the most-produced crops worldwide, with an estimated annual production of 713 million tons (Food and Agricultural Organization of the United Nations, 2010 Crop Production Data, online at faostat.fao.org/site/567/DesktopDefault.aspx?PageID=567#ancor). Wheat grain is used to make flour for breads, cakes, pastas, and biscuits, and to make beer. One of the major nutritional components in wheat flour is starch. Wheat starch consists of glucose monomers connected by α1,4 and α1,6 linkages. The resulting polymers are grouped into two classes: amylose and amylopectin. Amylopectin has mostly α1,6 linkages and is highly branched, while amylose has mostly α1,4 linkages and is largely unbranched. Due to their relatively linear structure, amylose molecules are tightly packed and are insoluble, and are more resistant to digestion than amylopectin (Tetlow, *Seed Science Research*, 21:5-32, 2011).

SUMMARY

This document provides materials and methods for generating wheat varieties with increased levels of amylose, resistant starch, and dietary fiber, relative to the levels in corresponding wild type wheat varieties. Starch within wheat grains typically is comprised of about 25% amylose and 75% amylopectin. Due to its highly branched structure, amylopectin is quickly degraded, making it a rich source for glucose. On the other hand, amylose has a tightly packed structure and is more resistant to digestion. Foods high in resistant starches have the potential to lower the rate of glucose entry into circulation, and to decrease the risk of diet-related noninfectious chronic diseases, including heart disease, colon cancer, and diabetes (see, e.g., Regina et al., *Proc Natl Acad Sci USA*, 103:3546-3551, 2006; Kendall et al., *J AOAC Int*, 87:769-774, 2004; Brouns et al., *Trends Food Sci Tech*, 13:251-261, 2002; and Bird et al., *Beneficial Microbes*, 1:423-431, 2010).

Branch formation in amylopectin is catalyzed by starch-branching enzymes that cleave internal α1,4 bonds and transfer the reducing ends to C-6 hydroxyls. In wheat, branch formation is regulated by two classes of starch-branching enzymes (SBEs), SBEI and SBEII. This disclosure is based, at least in part, on the discovery that wheat varieties with increased levels of amylose, resistant starch, and dietary fiber can be generated using sequence-specific nucleases to make targeted mutations or knockouts of the SBEII genes and their alleles. The modified wheat varieties can have enhanced nutritional qualities as compared to non-modified wheat varieties. Further, the modified wheat varieties do not carry foreign DNA and therefore may have reduced regulatory burden. This document also is based, at least in part, on the development of wheat varieties with loss-of-function SBEII mutations that are created by sequence-specific nucleases. Thus, in some embodiments, this document provides a *Triticum* plant, plant part, or plant cell having a mutation in at least two SBEII alleles from the SBEIIa and/or SBEIIb genes (e.g., at least two SBEII alleles, at least four SBEII alleles, at least six SBEII alleles, at least at least eight SBEII alleles, or at least twelve SBEII alleles) endogenous to the plant, plant part, or plant cell such that the plant, plant part, or plant cell has reduced expression of SBEII alleles as compared to a control *Triticum* plant, plant part, or plant cell that lacks the mutation.

In a first aspect, this document features a *Triticum* plant, plant part, or plant cell comprising a deletion or insertion in at least two SBEII alleles endogenous to the plant, plant part, or plant cell, wherein the deletion or insertion was made using a rare-cutting endonuclease. The at least two SBEII alleles can include SBEIIa alleles, SBEIIb alleles, or SBEIIa and SBEIIb alleles. The at least two SBEII alleles each can have a deletion of one or more nucleotide base pairs. The at least two SBEII alleles each can include an insertion of one or more nucleotide base pairs endogenous to the plant, plant part, or plant cell. The plant, plant part, or plant cell can have a deletion of one or more SBEII alleles. The insertion or deletion can be at a target sequence as set forth in SEQ ID NO:1, or at a target sequence having at least 90% identity to SEQ ID NO:1. The rare-cutting endonuclease can be a transcription activator-like effector endonuclease (TALE nuclease). The TALE nuclease can bind to a sequence as set forth in SEQ ID NO:1. In some cases, the SBEII alleles can be SBEIIa alleles, where every endogenous SBEIIa allele has a deletion or insertion. The at least two SBEII alleles can be SBEIIa alleles, where the SBEIIa alleles include the sequences set forth in SEQ ID NO:11910, 11912, and 11915, or the sequences set forth in SEQ ID NO:11910, 11913, and 11915. The at least two SBEII alleles can be SBEIIb alleles, where every endogenous SBEIIb allele has a deletion or insertion. In some cases, every endogenous SBEIIa and SBEIIb allele can have a deletion or insertion. Each of the at least two SBEII alleles can exhibit removal of an endogenous nucleic acid, without including any exogenous nucleic acid. The plant part can be grain. The grain can be milled, ground, pearled, rolled, kibbled, par-boiled, or cracked grain. The *Triticum* plant, plant part, or plant cell can be of the species *Triticum aestivum, Triticum aethiopicum, Triticum araraticum, Triticum boeoticum, Triticum carthhcum, Triticum compactum, Triticum dicoccoides, Triticum dicoccon, Triticum durum, Triticum ispahanicum, Triticum karamyschevii, Triticum macha, Triticum militinae, Triticum monococcum, Triticum polonicum, Triticum spelta, Triticum sphaerococcum, Triticum timopheevii, Triticum turanicum, Triticum turgidum, Triticum urartu, Triticum vavilovii,* or *Triticum zhukovskyi*. The plant, plant part, or plant cell can have increased levels of dietary fiber as compared to a control plant, plant part, or plant cell that lacks the deletion or insertion.

In another aspect, this document features a method for generating a *Triticum* plant that has increased levels of dietary fiber, where the method includes (a) contacting a *Triticum* plant cell or plant part having functional SBEII alleles with a rare-cutting endonuclease targeted to an endogenous SBEII allele, (b) selecting from the plant cell or plant part a plant cell or plant part in which at least one SBEII allele has a deletion or insertion due, at least in part, to nuclease activity of the rare-cutting endonuclease, and (c) growing the selected plant cell or plant part into a *Triticum* plant, where the *Triticum* plant has increased levels of dietary fiber as compared to a control *Triticum* plant in which the SBEII alleles have not been mutated. The rare-cutting endonuclease can be a TALE nuclease, Cas9/gRNA, zinc-finger nuclease, or meganuclease. The *Triticum* plant cell can be s a protoplast. The contacting can include transforming the protoplast with a nucleic acid encoding the rare-cutting endonuclease. The nucleic acid can be an mRNA, or can be contained within a vector. The method can further include culturing the protoplast to generate a plant line. The method can further include isolating genomic DNA comprising at least a portion of the at least one SBEII allele from the protoplast. The *Triticum* plant part can be an immature embryo, embryogenic callus, or scutella. The contacting can include transforming the immature embryo, embryogenic callus, or scutella with a nucleic acid encoding the rare-cutting endonuclease. The transforming can include *Agrobacterium*-mediated transformation or biolistics. The method can further include culturing the immature embryo, embryogenic callus, or scutella to generate a plant line. The method can further include isolating genomic DNA comprising at least a portion of the at least one SBEII allele from the immature embryo, embryogenic callus, or scutella. The deletion or insertion can be at a target sequence as set forth in SEQ ID NO:1, or at a target sequence having at least 90% identity to SEQ ID NO:1. The selected plant cell or plant part can have a deletion or insertion in two or more endogenous SBEIIa alleles. The two or more SBEIIa alleles can contain the sequences set forth in SEQ ID NO:11910, 11912 and 11915, or the deletions shown in SEQ ID NO:11910, 11913, and 11915. The *Triticum* plant cell or plant part can be of the species *Triticum aestivum, Triticum aethiopicum, Triticum araraticum, Triticum boeoticum, Triticum carthhcum, Triticum compactum, Triticum dicoccoides, Triticum dicoccon, Triticum durum, Triticum ispahanicum, Triticum karamyschevii, Triticum macha, Triticum militinae, Triticum monococcum, Triticum polonicum, Triticum spelta, Triticum sphaerococcum, Triticum timopheevii, Triticum turanicum, Triticum turgidum, Triticum urartu, Triticum vavilovii,* or *Triticum zhukovskyi*.

In another aspect, this document features a *Triticum* plant, plant part, or plant cell having a mutation in at least two SBEII alleles endogenous to the plant, plant part, or plant cell, such that the plant, plant part, or plant cell has reduced expression of SBEII as compared to a control *Triticum* plant, plant part, or plant cell that lacks the mutation. The at least two SBEII alleles can be SBEIIa alleles, SBEIIb alleles, or SBEIIa and SBEIIb alleles. Each mutation can be a deletion of one or more nucleotide base pairs, or an insertion of one or more nucleotide base pairs endogenous to the plant, plant part, or plant cell. The mutation can include a deletion of one or more SBEII alleles. In some embodiments, the mutation can include a combination of two or more of: deletion of one or more alleles, inversion of one or more alleles, insertion of one or more nucleotides within an allele, deletion of one or more nucleotides from an allele, and substitution of one or more nucleotides within an allele. The mutation can be at a target sequence as set forth in SEQ ID NO:1, or at a target sequence having at least 90% identity to SEQ ID NO:1. The plant, plant part, or plant cell can be made using a rare-cutting endonuclease (e.g., a TALE nuclease). The TALE nuclease can bind to a sequence as set forth in SEQ ID NO:1. Every endogenous SBEIIa allele can be mutated, and in some cases, the plant, plant part, or plant cell may have no detectable expression of SBEIIa. Every endogenous SBEIIb allele can be mutated, and in some cases, the plant, plant part, or plant cell may have no detectable expression of SBEIIb. In some embodiments, every endogenous SBEIIa and SBEIIb allele can be mutated, and in some cases, the plant, plant part, or plant cell may have no detectable expression of SBEIIa and SBEIIb. Each of the at least two SBEII alleles can exhibit removal of an endogenous nucleic acid, without including any exogenous nucleic acid. The *Triticum* plant, plant part, or plant cell can be of the species *Triticum aestivum, Triticum aethiopicum, Triticum araraticum, Triticum boeoticum, Triticum carthlicum, Triticum compactum, Triticum dicoccoides, Triticum dicoccon, Triticum durum, Triticum ispahanicum, Triticum karamyschevii, Triticum macha, Triticum militinae, Triticum monococcum, Triticum polonicum, Triticum spelta, Triticum sphaerococcum, Triticum timopheevii, Triticum turanicum, Triticum turgidum, Triticum urartu, Triticum vavilovii,* or *Triticum zhukovskyi*. The plant, plant part, or plant cell can have increased levels of amylose as compared to a control plant, plant part, or plant cell that lacks the mutation.

In another aspect, this document features a method for generating a *Triticum* plant that has increased levels of amylose. The method can include (a) contacting a *Triticum* plant cell or plant part having functional SBEII alleles with a rare-cutting endonuclease targeted to an endogenous SBEII allele; (b) selecting from the plant cell or plant part a plant cell or plant part in which at least one SBEII allele has a mutation due, at least in part, to nuclease activity of the rare-cutting endonuclease; and (c) growing the selected plant cell or plant part into a *Triticum* plant, wherein the *Triticum* plant has increased levels of amylose as compared to a control *Triticum* plant in which the SBEII alleles have not been mutated. The rare-cutting endonuclease can be a TALE nuclease, Cas9/gRNA, zinc-finger nuclease, or meganuclease. The *Triticum* plant cell can be a protoplast. The contacting can include transforming the protoplast with a nucleic acid encoding the rare-cutting endonuclease. The nucleic acid can be an mRNA. The nucleic acid can be contained within a vector. The method can further include culturing the protoplast to generate a plant line, and/or isolating genomic DNA containing at least a portion of the at least one SBEII allele from the protoplast. The *Triticum* plant part can be an immature embryo, embryogenic callus, or scutella. The contacting can include transforming the embryo, embryogenic callus, or scutella with a nucleic acid encoding the rare-cutting endonuclease. The transforming can include *Agrobacterium*-mediated transformation or biolistics. The method can further include culturing the immature embryo, embryogenic callus, or scutella to generate a plant line, and/or isolating genomic DNA containing at least a portion of the at least one SBEII allele from the immature embryo, embryogenic callus, or scutella. The mutation can be at a target sequence as set forth in SEQ ID NO:1, or at a target sequence having at least 90% identity to SEQ ID NO:1. The selected plant cell or plant part can have a mutation in two or more endogenous SBEII alleles. The *Triticum* plant cell or plant part can be of the species *Triticum aestivum, Triticum aethiopicum, Triticum araraticum, Triticum boeoticum, Triticum carthhcum, Triticum compactum, Triticum dicoccoides, Triticum dicoccon, Triticum durum, Triticum ispahanicum, Triticum karamyschevii,*

*Triticum macha, Triticum militinae, Triticum monococcum, Triticum polonicum, Triticum spelta, Triticum sphaerococcum, Triticum timopheevii, Triticum turanicum, Triticum turgidum, Triticum urartu, Triticum vavilovii,* or *Triticum zhukovskyi.*

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

DESCRIPTION OF DRAWINGS

FIG. 1 shows the *T. aestivum* nucleotide sequences of exon 2 from SBEIIa-A (SEQ ID NO:11890), exon 3 from SBEIIa-A (SEQ ID NO:11891), exon 2 from SBEIIa-B (SEQ ID NO:11892), exon 3 from SBEIIa-B (SEQ ID NO:11893), exon 2 from SBEIIa-D (SEQ ID NO:11894), and exon 3 from SBEIIa-D (SEQ ID NO:11895).

FIG. 3 shows target sequences for TALE nuclease pairs SBEIIa_T1, SBEIIa_T2, and SBEIIa_T3. Specifically, target sequences are shown for SBEIIa_T1 in the SBEIIa-A gene (SEQ ID NO:11896), SBEIIa-B gene (SEQ ID NO:11896), and SBEIIa-D gene (SEQ ID NO:11897); for SBEIIa_T2 in the SBEIIa-A gene (SEQ ID NO:11898), SBEIIa-B gene (SEQ ID NO:11899), and SBEIIa-D gene (SEQ ID NO:11899); and for SBEIIa_T3 in the SBEIIa-A gene (SEQ ID NO:11900), SBEIIa-B gene (SEQ ID NO:11900), and SBEIIa-D gene (SEQ ID NO:11901).

FIG. 4 shows the mutations in the SBEIIa-A, B and D genes from plant Ta125-2. The SBEIIa-A gene had a 2 bp insertion (SEQ ID NO:11909) and a 23 bp deletion (SEQ ID NO:11910). The SBEIIa-B gene had a 4 bp deletion (SEQ ID NO:11912) and a 20 bp deletion (SEQ ID NO:11913). The SBEIIa-D gene had a 4 bp deletion (SEQ ID NO:11915) and a 12 bp deletion (SEQ ID NO:11916).

FIG. 5 shows the mutations in the SBEIIa-B and D genes from plant Ta128-1. The SBEIIa-B gene had a 1 bp insertion (SEQ ID NO:11917) and a 1 bp deletion (SEQ ID NO:11918). The SBEIIa-D gene had a 21 bp deletion (SEQ ID NO:11919) and an 890 bp deletion (SEQ ID NO:11920).

FIGS. 6A and 6B show the mutations in the SBEIIa-A, B and D genes from plant Ta137-1. The SBEIIa-A gene had a 4 bp deletion (SEQ ID NO:11921), a 7 bp deletion (SEQ ID NO:11922), a 13 bp deletion (SEQ ID NO:11923), and a 167 bp deletion (SEQ ID NO:11924). The SBEIIa-B gene had a 17 bp deletion (SEQ ID NO:11925). The SBEIIa-D gene had a 6 bp deletion (SEQ ID NO:11926), 10 bp deletion (SEQ ID NO:11927), 13 bp deletion (SEQ ID NO:11928), 14 bp deletion (SEQ ID NO:11929) and 15 bp deletion (SEQ ID NO:11930).

FIG. 7 shows the mutations in the SBEIIa-A, B and D genes from plant Ta139-1. The SBEIIa-A gene had a 4 bp deletion (SEQ ID NO:11931). The SBEIIa-B gene had a 4 bp deletion (SEQ ID NO:11932), 10 bp deletion (SEQ ID NO:11933), and 22 bp deletion (SEQ ID NO:11934). The SBEIIa-D gene had a 11 bp deletion (SEQ ID NO:11935) and a 17 bp deletion (SEQ ID NO:11936).

FIG. 8 shows the mutations in the SBEIIa-A, B and D genes from plant Ta125-2-14. Both SBEIIa-A alleles had a 23 bp deletion (SEQ ID NO:11910). Both SBEIIa-B alleles had a 4 bp deletion (SEQ ID NO:11912). Both SBEIIa-D alleles had a 12 bp deletion (SEQ ID NO:11916).

FIG. 9 shows the mutations in the SBEIIa-A, B and D genes from plant Ta125-2-44-1-1a (-23/-23, -4/-4, -4/-4). Both SBEIIa-A alleles had a 23 bp deletion (SEQ ID NO:11910). Both SBEIIa-B alleles had a 4 bp deletion (SEQ ID NO:11912). Both SBEIIa-D alleles had a 4 bp deletion (SEQ ID NO:11915).

FIG. 10 shows the mutations in the SBEIIa-A, B and D genes from plant Ta125-2-44-1-2a (-23/-23, -20/-20, -4/-4). Both SBEIIa-A alleles had a 23 bp deletion (SEQ ID NO:11910). Both SBEIIa-B alleles had a 20 bp deletion (SEQ ID NO:11913). Both SBEIIa-D alleles had a 4 bp deletion (SEQ ID NO:11915).

FIGS. 11A-11C are graphs plotting plant height (FIG. 11A), number of seeds per spike (FIG. 11B), and germination efficiency (FIG. 11C) for *T. aestivum* plants with complete knockout mutations within SBEIIa alleles (Ta125-2-44-1-1a and Ta125-2-44-1-2a) as compared to wild type.

DETAILED DESCRIPTION

Figure 2:
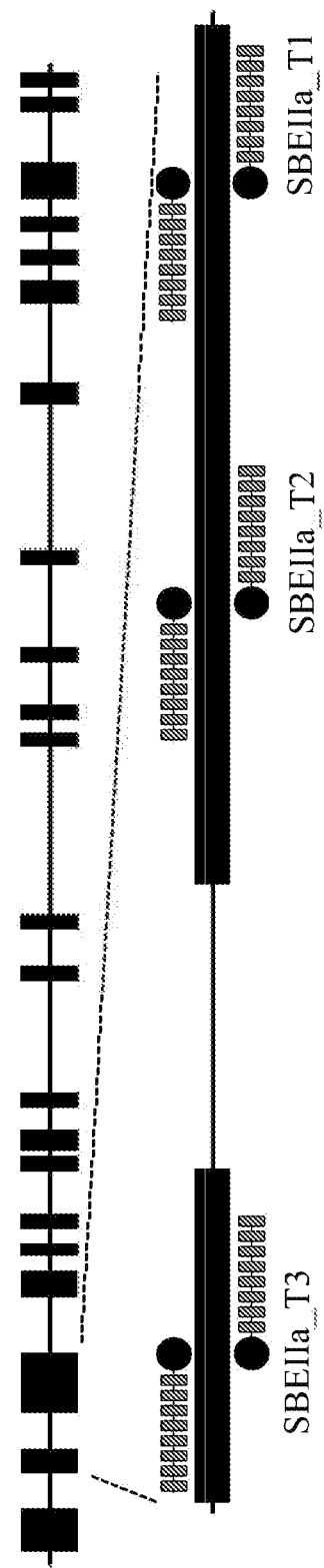
FIG. 2 is an illustration of an SBEIIa gene and the relative TALE nuclease binding sites for TALE nuclease pairs SBEIIa_T1, SBEIIa_T2, and SBEIIa_T3.

This document provides materials and methods for generating wheat varieties with increased levels of amylose, resistant starch, and dietary fiber relative to corresponding wild type wheat varieties. Wheat starches typically are composed of about 25% amylose (linear chains of glucose connected by α1,4 linkages) and 75% amylopectin (linear chains of glucose with frequent branching by α1,6 linkages). Amylopectin is quickly degraded due to its highly branched structure, which provides many sites to which enzymes can bind. Amylopectin therefore is a rich source for glucose. Branch formation within amylopectin is catalyzed by starch-branching enzymes, which cleave internal α1,4 bonds and transfer the reducing ends to C-6 hydroxyls. In wheat, branch formation is regulated by two classes of starch-branching enzymes (SBEs): SBEI and SBEII. The SBEII class is most responsible for amylopectin synthesis, as loss of SBEI has minimal effects on starch synthesis and composition (Blauth et al., *Plant Mol Biol,* 48:287-297, 2002). The SBEII class includes two gene products, SBEIIa and SBEIIb, which have distinct tissue-specific expression patterns. While SBEIIb is expressed exclusively in nonphotosynthetic storage tissues (endosperm), SBEIIa is ubiquitously expressed, and is expressed at much higher levels than SBEIIb within wheat endosperm (Blauth et al., Planta, 222:899-906, 2005).

The ratio of amylose to amylopectin in wheat can be altered by modifying the expression profile of enzymes involved in starch synthesis. For example, SBEIIa knockdown can be achieved using RNAi technology (Regina et al., *Proc Natl Acad Sci USA,* 103:3546-3551, 2006; and Sestili et al., *BMC Plant Biology,* 10:144, 2010) or by TILLING (Targeting Induced Local Lesions in Genomes; Slade et al., *BMC Plant Biology,* 12:69, 2012; Hazard et al., *Crop Science,* 52:1754-1766, 2012). Using such techniques, wheat varieties have been generated containing ratios of amylose to amylopectin ranging from ~40:60 to 70:30, as compared to the ~25:75 ratio in wild type plants. These technologies frequently result in incomplete silencing or inactivation of the target gene, such that residual enzyme activity may prevent the maximum possible phenotypic change. RNAi also requires the creation of transgenic lines that stably express the RNA sequence over multiple generations.

As described herein, by using sequence-specific nucleases, a maximum level of amylose content can be achieved through complete gene knockout. Efforts to engineer high amylose in wheat using sequence-specific nucleases must address challenges related to the complexity of the wheat genome. For example, the bread wheat genome is allohexaploid, with three different genomes (termed A, B, and D), and is 17 Gbp in size—five times larger than the human genome. In addition, a high percentage (80-90%) of the genome is repetitive sequence. Efforts are further challenged by the three non-identical homoeoalleles of SBEIIa and SBEIIb.

This document provides strategies for using sequence-specific nucleases to successfully target the SBEII alleles within wheat. This document also provides wheat plant varieties (e.g., *T. aestivum* varieties) that contain increased levels of amylose, resistant starch, and dietary fiber. Methods for generating such plant varieties also are provided.

As used herein, the terms "plant" and "plant part" refer to cells, tissues, organs, grains, and severed parts (e.g., roots, leaves, and flowers) that retain the distinguishing characteristics of the parent plant. "Grain" refers to any plant structure that is formed by continued differentiation of the ovule of the plant, following its normal maturation point, irrespective of whether it is formed in the presence or absence of fertilization and irrespective of whether or not the grain structure is fertile or infertile.

The term "allele(s)" means any of one or more alternative forms of a gene at a particular locus. In a diploid (or amphidiploid) cell of an organism, alleles of a given gene are located at a specific location or locus on a chromosome, with one allele being present on each chromosome of the pair of homologous chromosomes. Similarly, in a hexaploid cell of an organism, one allele is present on each chromosome of the group of six homologous chromosomes. In a tetraploid cell, one allele is present on each chromosome of the group of four homologous chromosomes. "Heterozygous" alleles are different alleles residing at a specific locus, positioned individually on corresponding homologous chromosomes. "Homozygous" alleles are identical alleles residing at a specific locus, positioned individually on corresponding homologous chromosomes in the cell.

The term "gene" as used herein refers to a sequence of DNA that encodes a protein. "SBEII genes" are sequences of DNA endogenous to the wheat genome that encode SBEIIa or SBEIIb proteins. "SBEIIa genes" are sequences of DNA endogenous to the wheat genome that encode SBEIIa proteins. "SBEIIb genes" are sequences of DNA endogenous to the wheat genome that encode SBEIIb proteins. The term "SBEII genes" also refers to alleles of SBEII genes that are present at the same chromosomal position on homologous chromosomes. A "wild type SBEII gene" is a naturally occurring SBEII gene (e.g., as found within naturally occurring *T. aestivum* plants) that encodes an SBEIIa or SBEIIb protein, while a "mutant SBEII gene" is an SBEII gene that has incurred one or more sequence changes, where the sequence changes result in the loss or modification of amino acids within the translated protein, as compared to the wild type SBEII gene. Such a "mutant SBEII gene" can include one or more mutations in an SBEII gene's nucleic acid sequence, where the mutation(s) result in absence or reduced levels of SBEIIa or SBEIIb proteins in the plant or plant cell in vivo. Additionally, a "mutant SBEII gene" can include an SBEII gene for which the full length coding sequence has been deleted from the wheat genome, such that it is no longer capable of producing SBEII protein. Further, a "mutant SBEII gene" can include an SBEII gene in which an in-frame insertion or deletion has occurred in a region of the gene coding sequence that encodes essential amino acids for SBEIIa or SBEIIb protein function.

Many *Triticum* species are hexaploid and contain three different genomes, termed A, B, and D. Accordingly, there are three SBEIIa genes, one on each of the three genomes in such *Triticum* species, resulting in a total of six SBEIIa alleles in the wheat genome. The SBEIIa gene present on the A genome has two alleles and is referred to herein as SBEIIa-A; the SBEIIa gene present on the B genome has two alleles and is referred to herein as SBEIIa-B; and the SBEIIa gene present on the D genome has two alleles and is referred to herein as SBEIIa-D. The methods provided herein can be used to inactivate all six SBEIIa alleles using one or more TALE nuclease pairs. Other *Triticum* species are diploid or tetraploid. The methods provided herein can be used to inactivate both or all four SBEIIa alleles of such diploid or tetraploid species using one or more TALE nuclease pairs.

The term "high amylose" or "high levels of amylose" as used herein refers to differences in the ratio of amylose to amylopectin in modified wheat plants, as compared to non-modified wheat plants. Specifically, the ratio of amylose to amylopectin in modified plants is increased compared to non-modified plants (e.g., if most wild type wheat plants contain a ratio of 25:75, then the ratio in a modified plant can be 30:70, 40:60, 50:50, 60:40, 70:30, 80:20, 90:10, or 100:0). "High amylose" also refers to modified wheat plants having decreased levels of amylopectin.

A representative example of a naturally occurring *T. aestivum* SBEIIa nucleotide sequence from the A genome is shown in SEQ ID NO:1:

```
                                                     (SEQ ID NO: 1)
ATGGCGACGTTTGCGGTGTCCGGCGCGACCCTCGGTGTGGCGCGGCCCGCCGGCGCCGGCGG

CGGACTGCTGCCGCGATCCGGCTCGGAGCGGAGGGGCGGGGTGGACCTGCCGTCGCTGCTCC

TCAGGAAGAAGGACTCCTCTCGTACGCCTCGCTCGCTCGCTCCAATCTCCCCGTCCATTTTT

GCCCCCCTTCTCTCTCCCTATCTGCGCGCGCATGGCCTGTTCGATGCTGTTCCCCAGTTGAT

CTCCATCAACGAGAGAGATAGCTGGATTAGGCGATCGCCTGCGTCAGTGTCACCCAGGCCCT

GGTGTTATCACGGCTTTGATCATCTCCTCCCATTCTGATATTTTCTCACTCTTTCTTCTGTT
```

-continued

CTTGCTGTAACTGCAAGTTGTAGCATTGTCTCACTATTGTAGTCATCCTTGCATTGCAGGCG

CCGTCCTGAGCCGCGCGGCCTCTCCAGGGAAGGTCCTGGTGCCTGACGGTGAGAGCGACGAC

TTGGCAAGTCCGGCGCAACCTGAAGAATTACAGGTACACACCATCGTGCCGGGAAATCTTCA

TACAATCGTTATTCACTTACCAAATGCCGGATGAAACCAAGCCGCGGAGGCGTCAGGTTTTG

AGCTTCTTCTATCAGCATTGTGCAGTACTGCACTGCCTTGTGCATTTTGTTAGCCGTGGCCC

CGTGCTGGCTCTTGGGCCACTGAAAACTCAGATGGATGTGCATTCTAGCAAGAACTTCACGA

AATAATGCACTGTTTGTGGTTTCGTTAGTCTGCTCTACAATTGCTATTTTCGTGCTGTAGAT

ACCTGAAGACATCGAGGAGCAAACGGCTGAAGTAAACATGACAGGGGGGACTGCAGAAAAAC

TTGAATCTTCAGAACCGACTCAAGGCATTGTGGAAACAATCACTGATGGTGTAACCAAGGA

GTTAAGGAACTAGTCGTGGGGGAGAAACCGCGAGTTGTCCCAAAACCAGGAGATGGGCAGAA

AATATACGAGATTGACCCAACGCTGAAAGATTTTCGGAGCCATCTTGACTACCGGTAATGCC

TACCCGCTACTTTCGCTCATTTTGAATTAAGGTCCTTTCGTCATGCAAATTTGGGGAACATC

AAAGAGACAAAGACTAGGGACCACTATTTCTTACAGTTCCCCTCATGGTCTGAGAATATGCT

GGGACGTAGATGTATAATTGATGGCTACAATTTGCTCATAATTACGATACAAATAACTGTCT

CTGATCATTGCAATTACAGAGTGGCAAACTGATTAAAATGTGATAGATGGGTTATAGATTTT

ACTTTGCTAATTCCTCTACCAAATTCCTGGGGAAAAAAATCTACCAGTTGGGCAACTTAGTT

TCTTATCTTTGTTGCCTCTTTGTTTGGGGAAAACACACTGCTAAATTTGAATGATTTTGGG

TATGCCTCCGTGGATTCAACAGATACAGCGAATACAGGAGAATTCGTGCTGCTATTGACCAA

CATGAAGGTGGATTGGAAGCATTTTCTCGTGGTTATGAAAAGCTTGGATTTACCCGCAGGTA

AATTTAAAGCTTCAGTATTATGAAGCGCCTCCACTAGTCTACTTGCATATCTTACAAGAAAA

TTTATAATTCCTGTTTTCGCCTCTCTTTTTTCCAGTGCTGAAGGTATTGTCTAGTTGCATAT

CTTATAAGAAAATTTATGTTCCTGTTTTCCCCTATTTTCCAGTGCTGAAGGTATCACTTACC

GAGAATGGGCTCCTGGAGCGCATGTACGTCTTTTAAGTCTTAACAGACACCTTCCAATTCAT

TGTTAATGGTCACACTATTCACCAACTAGCTTACTGGACTTACAACTTAGCTTACTGAATAC

TGACCAGTTGCTCTAAATTTATGATCTGGCTTTTGCATCCTATTACAGTCTGCAGCATTAGT

AGGTGACTTCAACAATTGGAATCCGAATGCAGATACTATGACCAGAGTATGTCTACAGCTTG

GCAATCTTCCACCTTTGCTTCATAACTACTGATACATCTATTTGTATTTATTTTGCTGTTTG

CACATTCCTTAAAGTTGAGCCTCAACTATATCATATCAAAATGGTATAATTTGTCAGTGTCT

TAAGCTTCAGCCTAAAGATTCTACTGAAATTGGTCCATCTTTTTGAGATTGAAAATGAGTAT

ATTAAGGATGGATGAATAGGTGCAACACTCCCATTCTTTGGTAGAACCTTCTGCATTATGTG

TGTTTTTTCATCTACAATGAGCATATTTCCATGCTATCAGTGAAGGTTTGCTCCTATTGATG

CCGATATTTGATATGATCTTTTCAGGATGATTATGGTGTTTGGGAGATTTTCCTCCCTAACA

ATGCTGATGGATCCCCAGCTATTCCTCATGGCTCACGTGTAAAGGTAAGCTGGCCAATTATT

TAGTTGAGCATGTAGCATTTTCGAACTCTGCCCACTAAGGGTCCCTTTGCCTTTCTGTTTTC

TAGATACGGATGGATACTCCATCTGGTGTGAAGGATTCAATTTCTGCTTGGATCAAGTTCTC

TGTGCAGGCTCCAGGTGAAATACCATTCAATGGCATATATTATGATCCACCTGAAGAGGTAA

GTATCGATCTCCATTACATTATTAAATGAAATTTCCAGTGTTACGGTTTTTTAATACCCATT

TCGTGTCTCACTGACATGTGAGTCAAGACAATACTTTAGAATTTGGAAGTGACATATGCATT

AATTCACCTTCTAAGGGCTAAGGGGCAAGCAACCATGGTGATGTTTGTATGCTTGTGTGTGA

CTTAAGATCTTATAGCTCTTTTATGTGTTCTCTGTTGGTTAGGATATTCCATTTTGACCTTT

TGTGACCATTTACTAAGGATATTTTACATGCAAATGCAGGAGAAGTATGTCTTCCAACATCC

```
-continued
TCAACCTAAACGACCAGAGTCACTGAGGATTTATGAATCACACATTGGAATGAGCAGCCCAG

TATGTCAATAAGTTATTTCACCTGTTTCTGGTCTGATGGTCTATTCTATGGATTTTTTAGTT

CTGTTATGTATTGTTAACATATAACATGGTGCATTCACGTGACAACCTCGATTTTATTTTCT

AATGTTATTGCAATAGCTCGGTATAATGTAACCATGTTACTAGCTTAAGATGGTTAGGGTTT

CCCACTTAGGATGTATGAAATATCGCATTGGAGCATCTCCAGCAAGCCATTTTTTTGACGGT

TAACAGCAGGAGCTCTGCTTTTCATTATAGGAGAGGGAAATGCTGTACAGACTGAAGTCAGT

CAGAGCAAAGTAACTTAGAATCATTTATGGGCCACCCTGCACAGGGCAGAAGGCAGGCAGGA

ACGATCCTCTACAGCCGTCGGATTGCCTCCATCAGAGGAATCCTGGCCGTTAATCATGCTCT

GGCCCAGTGGTCAGAATGCATCAACCAGACTGAGGTGCTCGCCTCCTTATTGGTAAAGGATG

CAGCGGTACGAGCCTATTGAACAGATCCTGTTCAAGTAAGGCCGTTCTCCAGCAAGCCATTT

CCTAGCTTATTAATGAGAGAGAGAGAGGGGGGGGGTCTGTATTCTGCGAGCAATTCAAAAAC

TTCCATTGTTCTGAGGTGTACGCATTGTAGGGATCTCCCATTATGAAGAGGATATAGTTAAT

TCTTTGTAACCTACTTGGAAACTTGAGTCTTGCGGCATCGCTAATATATTCTATCATCACAA

TACTTAGAGGATGCATCTGAATATTTTAGTGGGATCTTGCACAGGAACCGAAGATAAATTCA

TATGCTAATTTTAGGGATGAGGTGCTGCCAAGAATTAAAAGGCTTGGATACAATGCAGTGCA

GATAATGGCAATCCAGGAGCATTCATACTATGCGAGCTTTGGGTATTCACACAATCCATTTT

TTTCTGTTCTTTTTTCTGTATGCGCCTCTTCACCCATTTGGAGCTATTACATCCTAATGCTT

CGTGCACATAGAATATTTGGATATAATTCTTTAGTAGACATATAGTACAACAACAGTTGGTA

TTTCTGACTTGTATGACCATTTTATTGTTGTTGGCTTGTTCCAGGTACCATGTTACTAATTT

TTTTGCACCAAGTAGCCGTTTTGGAACTCCAGAGGACTTAAAATCCCTGATCGATAGAGCAC

ATGAGCTTGGTTTGCTTGTTCTTATGGATATTGTTCATAGGTAAGTAGTCCAATTAATTTTA

GCTGCTTTACTGTTTATCTGGTATTCTAAATGGCAGGGCCGTATCGACGAGTATTTTTCCAT

TCTATATAATTGTGCTACATGACTTCTTTTTTCTCAGATGTATTAAACCAGTTGGACATCAA

ATGTATTTGGTACATCTAGTAAACTGACAGTTTCAAAAGAACATCGTTTTGTAATGGCAACA

TGATTTGATGCCATAGATGTGGACTGAGAAGTTCAGATGCTATCAAGAAAATTAATCAACTG

GCCATGTACTCGTGGCACTACATAGAGTTTGCAAGTTGGAAAACTGACAGCAATACCTCACT

GATAAGTAGCTAGGCCCCACTTGCCAGCTTCATATTAGATGTTACTTCCCTGTTGAACTCAT

TTGAACATATTACTTAAAGTTCTTCATTTGTCCTAAGTCAAACTTCTTTAAGTTTGACCAAG

TCTACTGAAAAATATATCAACATCTACAACACCAAATTGGTTTCATTAGATTCACAATTTTT

ATTTTGTTATATTAGCACACCTTTGATGTTGTAGATATCAGCACATTTTTCTACAGACTTGG

TCAAATATAGAGAAGTTTGACTTAGGACAAATCTAGAACTTCAATCAATTTGGATCAGAGGG

GATAGTCCATACTGGTTGATTATATTCGGTAACATCAAATAATATAGATAGATGTCAACACT

TTAACAAAAAAATCAGACCTTGTCACCAAATATGTATCAGACCATCTGTTTGCTTTAGCCAC

TTGTTTTCATATTTATGTGTTTGTACCTAATCTATTTTTACTTCTACTTGGTTTGGTTGATT

TTTTTTCAGTTGCATTGCTTCATCAATGATTTTGTGTACCCTGCAGTCATTCATCAAATAAT

ACCCTTGACGGCTTGAATGGTTTCGATGGCACTGATACACATTACTTCCACGGTGGTCCACG

TGGCCATCATTGGATGTGGGATTCTCGTCTATTCAACTATGGGAGTTGGGAAGTATGTAGCT

CTGACTTCTGTCACCATATTTGGCTAACTGTTCCTGTTAAATCTGTTCTTACACATGTCGAT

ATTCTATTCTTATGTAGGTATTGAGATTCTTACTGTCAAACGCGAGATGGTGGCTTGAAGAA

TATAAGTTTGATGGATTTCGATTTGATGGGGTGACCTCCATGATGTATACTCACCATGGATT
```

-continued

```
ACAAGTAAGTCATCAAGTGGTTTCAGTAACTTTTTTAGGGCACTGAAATAATTGCTATGCAT

CATAACATGTATCATGATCAGGACTTGTGCTACGGAGTCTTAGATAGTTCCCTAGTACGCTT

GTACAATTTTACCTGATGAGATCATGGACGATTCGAAGTGATTATTATTTATTTTTCTTCTA

AGTTTGCTTCTTGTTCTAGATGACATTTACTGGGAACTATGGCGAGTATTTTGGATTTGCTA

CTGATGTTGACGCGGTAGTTTACTTGATGCTGGTCAACGATCTAATTCATGGACTTTATCCT

GATGCTGTATCCATTGGTGAAGATGTAAGTGCTTACAGTATTTATGATTTTTAACCAGTTAA

GTAGTTTTATTTTGGGATCAGGCTGTTACTCTTTTTGTTAGGGGTAAGATCTCTCTTTTCAT

AACAATGCTAATTTATACCTTGTATGATAATGCATCACTTAGGTAATTTGAAAAGTGCAAGG

CCATTCAAGCTTACGAGCATATTTTTTGATGGCTGTAATTTATTTGATAGTATGCTTGTTTG

GGTTTTTCAGTAAATGGGAGTGTGTGACTAATGTTGTATTAGAAATGGGCAACCTTGTCAAT

TGCTTCAGAAGGCTAACTTAGATTCCGTAAACGCTTCAGAAATGAGAGGCTATTCCCATGGA

CATGAAATTATACTTCAGTGTGTTCTGTACATGTATTTGTAAGAGCAAGAGCAACATGGTTT

AACTTAAATTCCTGCACTGCTATGGAATCTCACTGTATGTTGTTAGTGTAACATCCGCAAAC

AAGTAATCCTGAGCTTTCAACTCATGAGAAAATATGAGGTTCCACTTCTGCCAGCATTAACT

GTTCACAGTTCTAATTTGTGTAACTGTGAAATTGTTCAGGTCAGTGGAATGCCCACATTTTG

CATCCCTGTTCCAGATGGTGGTGTTGGTTTTGACTATCGCTTGCATATGGCTGTAGCAGATA

AATGGATTGAACTCCTCAAGTAAGTGCAGGAATATTGGTGATTACATGCGCACAATGATCTA

GATTACAATTTCTAAATGGTAAAAGGAAAATATGTATGTGAATATCTAGACATTTTCCTGTT

ATCAGCTTGTATACGAGAAGTCATACATGGTTTAAATAGCAAATCTCAGAAATGTAATGGCT

AGTGTCTTTATGCTGGACATTGTACATTGCGCTGTAGCAGGCCAGTCAACACAGTTAGCAAT

ATTTTCAGAAACAATAATTATTTATATCCGTATATGGGGAAAGTAGGTATATAAACTGTGGT

CATTAATTGTGTTCACCTTTTGTCCTGTATAAGCATGGGCAGTAGGTAATAAATTTAGCCAG

ATAAAATAAATCGTTATTAGGTTTACAAAAGGAATATACAGGGTCATGTAGCATATCTAGTT

GTAATTATTGAAAAGGCTGACAAAAGGCTCGGTAAAAAAAATCCAGATACGCAGGAACGCGA

CTAAAGCTCAAATATTTATAGTGGTCTCTGTTGCTTGCTGTATATTTGTATCTGCACATATA

TGAAATTACTACTACACAGCTGCCAATCTGTCATGATCTGTGTTCTGCTTTGTGCTATTTAA

ATTTTAATTCGATACATTGGCAATAATAAACTTAACTATTCAACCAATTTGGTGGATACCAG

AGATTTCTGCCCTCTTTTCGTAATGTTGTGCTCCTGCTGCTGTTCTCTGCTGTTACAAAAGC

TGTTCTCAGTTTTTTTACATCATTATTTTTGTGTGTGAGTACTTTTAGCATGTTTTTCGAAG

CTGTGAGTTGTTGGTACTTAATACATTCTTGGTAGTGTCCAAATATGCTGCAGTCTAATTTA

GCATTTCTTTAACACAGGCAAAGTGACGAATCTTGGAAAATGGGTGATATTGTGCACACCCT

AACAAATAGAAGGTGGCTTGAGAAGTGTGTAACTTATGCAGAAAGTCATGATCAAGCACTAG

TTGGTGACAAGACTATTGCATTCTGGTTGATGGATAAGGTACTAGCTGTTACTTTTGGACCA

AAAGAATTACACAATTGATTTGTCTCATCAGATTGCTAGTGTTTTCTTGTGATAAAGATTGG

CTGCGTCACCCATCACCAGCTATTTCCCAACTGTTACTTGAGCAAAATTTGCTGAAAACGTA

CCATGTGGTACTGTGGCGGCTTGTGAACTTTGACTGTTATGGTGCAAATTTCTGTTCTTATT

TTTTTGATTGCTTATGTTACCGTTCATTTGCTCATCCCTTTCAGAGACCAGCCAAAGTCACG

TGTAGCTGTGTGATCTATTATCTGAATCTTGAGCAAATTTTATTAATAGGGTAAAACCCAAC

GAATTATTTGCTTGAATTTTAATATACAGACGTATAGTCACCTGGTGCTTTCTTAAATGATT

ACCATAGTGCCTGAAGGCTGAAATAGTTTTGGCGTTTCTTGGACGCCGCCTAAAGGAGTGAT

TTTGGGTAGATTCCTGGTCGAGCCCTCGTTACAACATACATTTTGGAGATATGCTTAGTAAC
```

-continued

```
TGCTCTGGGAAGTTTGGTCAGAAGTCTGCATCTACACGCTCCTTGAGGTTTTATTATGACGC

CATCTTTGTAACTAGTGGCAGCTGTAAGGAAACACATTCAAAAGGAAACGGTCACATTATTC

TAGTCAGGACCACCACACTAAGAGGAATATTCTGTTCCAATTTTATGAGTTTTTGGGACTCC

AAAGGGAACAAAAGTGTCTCATATTGTGCTTATAACTACAGTTGTTTTTATACCAGTGTAGT

TCCATTCCAGGACAGTTGATACTTGGTACTGTGCTGTAAATTATTGATCTGGCATAGAACAG

CATGAACATATCAAGCTCTCTTTGTGCAGGATATGTATGATTTCATGGCTCTGGATAGGCCT

TCAACTCCTCGCATTGATCGTGGCATAGCATTACATAAAATGATCAGGCTTGTCACCATGGG

TTTAGGTGGTGAAGGCTATCTTAACTTCATGGGAAATGAGTTTGGGCATCCTGGTCAGTCTT

TACAACTTTAATTGCATTCTGCATAGTTGTGATTTACTGTAATTTGAACCATGCTTTGTTTT

CACATTGTATGTATTATGTAATCTGTTGCTTCCAAGGAGGAAGTTAACTTCTATTTACTTGG

CAGAATGGATAGATTTTCCAAGAGGTCCGCAAACTCTTCCAACCGGCAAAGTTCTCCCTGGA

AATAACAATAGTTATGATAAATGCCGCCGTAGATTTGATCTTGTAAGTTTTAGCTTAGCTAT

TACATTTCCTCACTAGATCTTTATCGGCCATTTATTTCTTGATGAAATCATAATGTTTGTTA

GGAAAGATCAACATTGCTTTTGTAGTTTTGTAGACGTTAACATAAATATGTGTTAAGAGTTG

TTGATCATTAAGAATATCATGATTTTTTGTAGGGAGATGCAGATTTTCTTAGATATCGTGGT

ATGCAAGAGTTCGATCAGGCAATGCAGCATCTTGAGGAAAAATATGGGGTATGTCACTGGTT

TGTCTTTGTTGCATAACAAGTCACAGTTTAACATTAGTCTCTTCAAATGGTCAAAAAGTGT

AGAATTAATTTCTGTAATGAGATGAAAACTGTGCAAAGGCGGGAGCTGGAATTGCTCTTCAC

CAATTAAAACTATTTTCTTGAGCGATAGTGTATTGATACCTATACCAACACTGACAATGTAA

CTGCAGTTTATGACATCTGAGCACCAGTATGTTTCACGGAAACACGAGGAAGATAAGGTGAT

CATCTTCGAAAGAGGAGATTTGGTATTTGTTTTCAACTTCCACTGGAGCAATAGCTTTTTTG

ACTACCGTGTTGGGTGTTCCAGGCCTGGGAAGTACAAGGTATGCTTTGCTTTTGCATTGTCC

ACCCTTCACCAGTAGGGTTAGTGGGGCTTCTACAACTTTTAAGTCCACATGTATAGAGTTT

GTTGGTCGTGCAGCTATCAATATAAAGAATATGATAATTTGTAAAGAAAAGAATTTGTTGCT

CGAGCTGTTGTAGTCATATAACATCCCCGAAGCACATCTACTATTCATTCATATTATCTACT

TAAGGGTTTGTTACAATCTTTGTACTCAGTTGGACTCACTCTAATACTGGAACTGTTTACCG

AATCTACCCTAATCATCCTAGCAGTTTTAGAGCAGCCCCATTTGGACAGTCCACTGGGTTTA

GTTGGTTTGTGACAGTTTCTGCTATTTCTTATCAGGTGGCCTTAGACTCCGACGATGCACTC

TTTGGTGGATTCAGCAGGCTTGATCATGATGTCGACTACTTCACAACCGTAAGTCTGGGCCC

AAGCGTTACTTGACTCGTCTTGACTCAACTGCTTACAAATCTGAATCAACTTCTCATTTGCT

GATGCCCTTGCAGGAACATCCGCATGACAACAGGCCGCGCTCTTTCTCGGTGTACACTCCGA

GCAGAACTGCGGTCGTGTATGCCCTTACAGAGTAA
```

The sequence of SEQ ID NO:1 is from the *T. aestivum* (cultivar Chinese Spring) SBEIIa gene within the A genome (GENBANK® accession HE591389.1). Bold nucleotides indicate exon 2 and exon 3 sequences.

A representative example of a naturally occurring *T. aestivum* SBEIIa nucleotide sequence from the B genome is shown in SEQ ID NO:5081:

(SEQ ID NO: 5081)

GTTGGTTTGCGATCCCGTCCTCCCTCCCGTCCCCTACGCAACGTCGCCTCCACCGTCCATCC

GTCGCTGCCACCTCTGTGCGCGCGCACGAGGGAGGAAGACGACGCAGCACACACACTCTCCC

CGTGGGTCCCCTTTCCGGCTTGGCGTCTATCTCCTCTCCCCCCCATCCCCATGCACTGCACA

GTACCCGCCAGCTTCCACCCCCGCCGCACACGTTGCTCCCCCTTCTCATCGCTTCTCAATTA

-continued

ATATCTCCATCACTCGGGTTCCGCGCTGCATTTCGGCCGGCGGGTTGAGTGAGATCTGGGCC

ACTGACCGACTCACTCGCTGCGCGGGGATGGCGACGTTCGCGGTGTCCGGCGCGACCCTCGG

TGTGGCGCGGCCCGCCAGCGCCGGCGGCGGACTGCTGCGATCCGGCTCGGAGCGGAGGGGCG

GGGTGGACTTGCCGTCGCTGCTCCTCAGGAAGAAGGACTCCTCTCGTACGCCTCGCTCCCTC

CAATCTCCCCGTCTGTTTTTGGGCCCCCTTCTCTCTCCCTCGCCTCTCTGCGCGCGCATGGC

CTGTTCGATGCTGTTCCCCAGTTGATCTCCATGAACGAGAGAGATAGCTGGATTAGGCGATC

GCCTCAGGCCCTGGTGTTACCACGGCTTTGATCATCTCCTCCTTTCATGCTGATATTTTCTC

ACTCTTTCTTCTGTTCTTGCTGTAACTGCAAGTTGTAGCATTTTTTTGGCGAATAAGTTGTA

GCATTGTCTCACTATTGTACTCATCCTTGCATTTGCAGGCGCCGTCCTGAGCCGCGCGGCCT

CTCCAGGGAAGGTCCTGGTGCCTGACGGTGAGAGCGACGACTTGGCGGCCACTCCAGCGCAA

CCCGAAGAATTACAGGTACACACCGTCGTGCCGGAAAATCTTCATGCACCCGTTATTCACTT

ACCAAATATCGGATGAACCAAGCCGCGGAGGCATCAGGTTTCAAGCTTCTTCTATCAGCATT

GTGCACTACTTCACTGCCTTGTGCAGTTTGTTAGCTGTGGCCCCGCGCTGGCTCTTGGGCCA

CTGAAAACTCAGATGGATGTGCATTCTAGCAAGAACTTCACAAAATAATGCACTGTTTGTGG

TTTCGTTAGTCTGCTCTACAATTGCTATTTTTCGTGTGCTGTAGATACCTGAAGATATCGAG

GAGCAAACGGCTGAAGTGAACATGACAGGGGGGACTGCAGAGAAACTTCAATATTCAGAACC

GACTCAGGGCATTGTGGAAACAATCACTGATGGTGTAACCAAAGGAGTTAAGGAACTAGTCG

TGGGGGAGAAACCGCGAGTTGTCCCAAAACCAGGAGATGGGCAGAAAATATACGAGATTGAC

CCAACGCTGAAAGATTTTCGGAGCCATCTTGACTACCGGTAATGCCTACCCGCTAATTTCGC

TCATTTTGAATTAAGGTCCTTTCATCATGCAAATTTGGGGAACATCAAAGAGGCAAAGACTA

GGGACCACTGTTTCATACAGTTCCCCTCATGGTCTGAGAATATGCTGGGAAGTATATGTATA

ATTGCTGGCTACAATTGGCTCATAATTGCAATACAAATAACTGTCTCCGATCATTACAATTA

CAGAGTGGCAAACTGATGAAAATGTGGTGGATGGGTTATGGATTTTACTTTGCTAATTCCTC

TACCAAATTCCTGGGGAAAAAATCTACCAGTTGGGCAACTTAGTTTCTTATCTTTGTTGCCT

TTTTGTTTTGGGGAAAACACACTGCTAAATTTGAATGATTTTGGGTATGCCTTGGTGGATTC

AACAGATACAGCGAATACAAGAGAATTCGTGCTGCTATTGACCAACATGAAGGTGGATTGGA

AGCATTTTCTCGTGGTTATGAAAAGCTTGGATTTACCCGCAGGTAAATTTAAAGCTTTACTA

TGAAACGCCTCCACTAGTCTAATTGCATATCTTGTAAGAAAATTTATAATTCCTGTTTTCCC

CTCTCTTTTTTCCAGTGCTGAAGGTATCATCTAATTGCTTATCTTATAAGAAAATTTATAAT

TCCTGTTTCCCCCCCTCTTTTTCCAGTGCTGAAGGTATCACTTACCGAGAATGGGCTCCTGG

AGCGCATGTACGTCTTAACAGACACCTTCTAATCTATTGTTAATGGTCACTATTCACCAACT

AGCTTACTGAACTTACAAAATAGCTTACTGAATACTGACCAGTTACTCTAAATTTATGATCT

GGCTTTTGCATCCTGTTACAGTCTGCAGCATTAGTAGGTGACTTCAACAATTGGAATCCAAA

TGCAGATACTATGACCAGAGTATGTCTACAGCTTGGCAATCTTCCACCTTTGCTTCGTAACT

ACTGATACATCTATTTGTATTTATTTAACTGTTTGCACGTTCGTTAAAGTTGAGCCTCAACT

ATATCATACCAAAATGGTATAATTTGTCAGTGTCTTAAGCTTCAGCCTAAAGATCCTACTGA

ATTTAGTCCATCCTTTTGAGATTGAAAATGAGTATATTAAGGGTGATTGAATACTTGCAACA

CTCCCATTTTTTGGTAGAACCTTTTGCATTATGTGTGCTTTTCCATCCACAATGAGCATATT

TCCATGTTATCAGTGAAGGTTTGCTCCTATTGATGCCGATATTTGATATGATCTTTCGATCT

TTTCAGGATGATTATGGTGTTTGGGAGATCTTCCTCCCTAACAATGCTGATGGATCCCCAGC

-continued

```
TATTCCTCATGGCTCACGTGTAAAGGTAATCTGGCCAATTATTTAGTCGAGGATGTAACATT

TTCGAACTCTGCCTACTAAGGGTCCCTTTTCCTCTCTATTTTCTAGATACGGATGGATACTC

CATCTGGTGTGAAGGATTCGATTTCTGCTTGGATCAAGTTCTCTGTGCAGGCTCCAGGTGAA

ATACCATTCAATGGCATATATTATGATCCACCTGAAGAGGTAAGTATCAATCTATGTTACAT

TATTAAATGGAATTTCCAGTGTTACAGTTTTTGATACCCACTTCATGTCTCACTGACATGT

GAGTCAAGACAATACTTTCGAATTTGGAAGTGACATATGCATTAATTCACCTTCTAAGGGCT

AAGGGGCAACCAACCATGGTGATGTGTGTATGCTTGTGTGACTTAAGATCTTATAGCTCTTT

TATATGTTCTCTGTTGGTTAGGACATTCCATTTTGACCTTTTGTGACCATTTACTAAGGATA

TTTTACATGCAAATGCAGGAGAAGTATGTCTTCCAACATCCTCAACCTAAACGACCAGAGTC

ACTAAGGATTTATGAATCACACATTGGAATGAGCAGCCCGGTATGTCAATAAGTTATTTCAC

CTGTTTCCGGTCTGATGGTTTATTCTATGGATTTTCTAGTTCTGTTATGTACTGTTAACATA

CCACACGGTGCATTCACGTGACAACCTCGATTTTATTTTCTAATGTCTTCATATTGGAAAAT

GCACAACTTTGCTTCCTCTTTGTCTGATCGTTTTTTTGTCTCTAAGATTTCCATTGCATTTC

GAGGTAGCGGGCATGTGAAAGTCGAATCTGAATATTTTTGTCAGAGCACAGTTATATTAAA

TGCCATTGTTGTTGCAATAGCTTGGTATAATGTAGCCATGTTACTAGCTTAAGAAATATCGC

ATTGGAGCATCTCCAGCAAGCCATTTCCTACCTTATTACTNNNNNNNNNNNNNNNNNNNNNN

NNNNNNNNNNNNNNNNNNNNNNNNNNNNNNNNNNNNNNNNNNNNNNNNNNNNNNNNNNNNNN

NNNNNNNNNNNNNNNNNCTGAATATTTTAGCGTGATCTTGCACAGGAACCGAAGATAAATTCA

TATGCTAATTTTAGGGATGAGGTGCTGCCAAGAATTAAAAGGCTTGGATACAATGCAGTGCA

GATAATGGCAATCCAGGAGCATTCATACTATGCAAGCTTTGGGTATTCATACAGTCCATCTT

TTTCTGTTTTTTTTTCTGTATGTGCCTCTTCACCCATTTCGAGCCATTACATCCTAATGCT

TCGTGCACATAAAATACTTGGATATAATTCTTTATTAGACATATAGTACAACACCACTTAGT

ATTTCTGACTTGTATGATCATTTTATTGTTGTTGGCTTGTTACAGGTACCATGTTACTAATT

TTTTTGCACCAAGTAGCCGTTTTGGAACTCCAGAGGACTTAAAATCCTTGATCGATAGAGCA

CATGAGCTTGGTTTGCTTGTTCTTATGGATATTGTTCATAGGTAATCAGTCCAATTTAATTT

TAGTTGCTTTACTGTTTATCTGGTATTGTAAATGGCAGGGCCCTATCGTCGAATATTTTCC

AATCTATATAATTGTGCTACATGACTTATTTTTTCTCAGATGTATTAAACCAGTTGGATATT

AAATGTATTTGGTACATCTAGTAAACTGACAGTTTCATAGAATTGTGTTGTAATGGCAACAC

AATTTGATGGCATAGATGTGGACTGAGAAGTTCAGATGCTATCAGTAATTAATTAACTGGCC

ATGTACTCGTGGAACTACATAGAGTTTGCAAGTTGGAAAACTGACAGCAATACCTCACTGAT

AAGTGTCCAGGCCACACTTGCCAGCTTCATATTAGATGTTACTTCCCTGTTGAACTCCTTTG

AACATATCACTTAAAGTTCTTCAATTGTCCTAAGTCAAACTTCTTTGACTTTGGCCAAGTCT

ATTGAAAAATATGTCAACATCTACAGCACCAAATTAGTTTCATAATTTTTATTTTGTTATAT

TAGCACGTTTTTTATGCTGTAGATATCAGCACATTTTTCTATAGACTTGGTCAAATATAGAG

AAGTTTGACTTAGGACAAATCAGAACTTCAAGCAATTTGGATCAGAGGGAATAGTCCATACT

GCTTGATTATATTTTCCCAAAGGAGGGAGTGAGGAGCTTGACTTCGGTATCATCAAATGATA

TTGATAGATGTCAACATTTTAACAAAAAATCAGACCTTGTCACCAAATATGCATCAGACCAT

CTGTTTGCTTAGGCACTTGCTTTCATATTTATGTGTTTGTAACTAATCTACTTTTCCTTCTA

CTTGGTTTGATTGATTCTATTTCAGTTGCATTGCTTCATCAATGATTTTGTGTACCCTGCAG

TCATTCGTCAAATAATACCCTTGACGGTTTGAATGGTTTCGATGGCACTGATACACATTACT

TCCACGGTGGTCCACGTGGCCATCATTGGATGTGGGATTCTCGTCTGTTCAACTATGGGAGT
```

-continued

```
TGGGAAGTATGTAGCTGCGACTTCTGTCACCATGTTTGGCTAACTGTTCCTGCCAATCTGTT

CTTACACGTGTCAATATTCTATTCTTATACAGGTATTAAGATTCTTACTGTCAAACGCGAGA

TGGTGGCTTGAAGAATATAAGTTTGATGGATTTCGATTTGATGGGGTGACCTCCATGATGTA

TACTCACCATGGATTACAAGTAAGTCATCAAGTGGTTTCAGTAACTTCTTCAGGGCACTGAA

ACAATTGCTATGCATCATAACATGTATCATGATCAGTACTTATGCTACGGAGTCTTAGATAG

TTCCCTAGTATGCTTGTACAATTTTACCTGATGAGATCATGGAAGATTGGAAGTGATTGTTA

TTATTTTTCCTTCTAAGTTTGCTTCTTGTTCTAGATGACATTTACTGGGAACTATGGCGAGT

ATTTTGGATTTGCCACTGATGTTGATGCGGTGGTATACTTAATGCTGGTCAACGATCTAATT

CATGGACTTTATCCTGATGCTGTATCCATTGGTGAAGATGTAAGTGCTTACAGTATTTATGT

TTTTTAACCAGTTAATTTAATAGTATTTTATTTTGGGGATCAAGCTGTTACTACTCTTTTTG

TTAGGGTAAAATCTGTCTTTTCATAAGAATGCTAATTTATACTCCCTCCGTCTGGAAATACT

TGTCGGAGGAATGAATGTATCTAGACGTATTTTAGTTCTAGATACATCCATTTTTATGCATT

TCTCCGTCAAGTATTTCCGGACGGAGGGAGTACCTTGTATGGTAATGCATCACATAGGTAAT

TTGAGAAGTGCAAGGGCATTCAAGCTGACAAGCATATTTGTTGATGGCTGTAATTTATTTGA

TAGTATGCTTGTTTGGATTTTTCAGTAAGTGTGAGTGTGTGAGTAATGTTATATTATTTATT

TACTTGCGGAAGAAATGGGCAACCTTGTCAATTGCTTCAGAAGACTAACTTAGATTCCATAA

ATGCTGTGGAAATGAGAGGCTATTCCCAAGGACACGAAATTATACGTCAGTGTGTTACGCAC

ATGTATTTGTAAGAGCAAGAGCAACATGGTTTAACTTAAATTCCTGCACTGCTATGGAATCT

CACTGTATGTTGTTAGTGTACGCATCCACAAACAAGTAATCCTGAGCTTTCAACTCACGAGA

AAATAGGAGGCTCCACTTCTGCCAGCATTAGCTGTTCACAGTTCTAATTTGTGTAACTCTGA

AATTGTTCAGGTCAGTGGAATGCCTACATTTTGCATCCCTGTTCCAGATGGTGGTGTTGGTT

TTGACTATCGCCTGCATATGGCTGTAGCAGATAAATGGATCGAACTCCTCAAGTAAGTGCAG

GAATATTGGTGATTACATGCGCACAATGATCTACTCCCTCTGTCCCATAATGTAAGATGTTT

TTTGACACTAGTGTAGTGTCAAAAAACGTCCTATATTATGGGAAGGAGGGAGTAGTTCACAA

TTTCTAAATTGTAAAAGAAAAATATGTATGTGAATAGCTAGACATTTCCCTGGTATCAGCT

TCAACACAAGAAGATTTATCAAATACATGATTTAAATAGCAAATTTCGGAAATGTAATGGCT

AGTGTCTTTATGCTGGATATTGTACATGGCGCTGTAGCAGGTGAGTCAATAAAGCTAGCGAT

ATTTTCAGAAACAAAATAATCATTTATATCTGTATATGGGGAAAGTGGGGGTATAGATGGTG

GTCATTAATCGTGTTCACTTTTTGTCCTGTATAAGCACAGGCAGTAGGTAATAAATTTAGCC

AGATAAAATAAATCGTTATTAGGTTTACAAAAGGAATACAGAGGGTCATGTAGCATATCTAG

TTGTAGTTATTGTAAAGGCTGACAAGAGGTTCAGTAAAAAAAACTTTATGTTGATCCCGGGT

ATGCAAGAACGCGAGTAAAGCTCAAACATTTATAGTGGTTGCTGTTGCTTGCTGTATACTTG

TATCTGCGCATATATGAAATTACTACTACACAGCTGCCAATCTGCCATGATCTGTGTTTTGC

TTTGTGCTATTTAAATTTTAAATGCTAACTCAATAAATGGCAATAATAAACTAACTATTCAA

CCAATTTGATGGATATCAGAGATTTCTTCCCTCCTTTAGTAACATTGTGCTCCTGCTGCTGT

TCTCTACCGTTACAAAAGCTGTTTTTCCATTTTTCGCATCATTATTTTTGTGTGTGAGTAAT

TTAAGCATGTCCTTTGAAGCTGTGAGCTGTTGGTACTTAGTACATTCTTGGTAGTGTCCAAA

TATGCTGCAGTCTAATTTAGCATTTCTATAACACAGGCAAAGTGACGAATCTTGGAAAATGG

GCGATATTGTGCACACCCTAACAAATAGAAGGTGGCTTGAGAAGTGCGTCACTTATGCAGAA

AGTCATGATCAAGCACTAGTTGGTGACAAGACTATTGCATTCTGGTTGATGGATAAGGTACT
```

-continued

```
AGCTGTTACTTTTGGATCAAAAGAATCACATAAGATTTGTCTCATCAGATTGCTCATGTTTT
CTTGTGATAAAGATTTGGCCCCCTCACCCATCACCAGCTATTTCCCAACTGTCACTTGAGCA
AAACGTGCCATGTGGCACTGTGGTGGCTTGTGAACTTTGACAGTTAATGTTGCAAATTTCTG
TTCTTATTTATTTGATTCTTATGTTATCGTTCATTTATTCCTCAAAAAATGTTATCGTTCAT
TTGCTCATTCCTTTCCGAGACCAGCCGAAGTCACGTGTAGCCATGTGATCTGCCATCTGAAT
CTTGAGCAAATTTTATGAAGAGGCTAAAGTCGAACGGATTATTTGCTTGAATTTATAAATAT
ACAGACGTATAATCACCTGGTGCTTTCTGAAATGATTACCATAGTGCCTGAAGGCTGAAATA
GTTTTGGCGTTTCCTGGACGACGCCCAAAGGAGTGAATTTTATTGGGTAGATTTCTGGCTGA
GCCCTGGTTACAACATACATTTTGGAGATATGCTTAATAACAAATCTGGGTGTTTGGTCACG
AGTCTGCATCTACATGCTCCTTGGGTTTTATTATGGCGTCATCTTTGTAACTAGTGGCACCC
CTAAGGAAACATTCAAAAGGAAACTGTTACATCATTCTAGTCAGGACCACCGTACTAAGAGC
AAAATTCTGTTCCAATTTTATGAGTTTTTGAGACTCCAAAATGAACATAAGTGTCTCATATT
TTGCTAATTAACTACAGATGTTTTATATCACTTTAGTTTTTATTTCAGGACAGTTGATACT
TGGTACTGTGCTGTAAGCATTGATCCGACACAGAACAGCATGAACATTTCGAGCTCTCTTTG
TGCAGGATATGTATGATTTCATGGCTCTGGATAGACCTTCAACTCCTCGCATTGATCGTGGC
ATAGCATTACATAAAATGATCAGGCTTGTCACCATGGGTTTAGGTGGCGAAGGCTATCTTAA
CTTCATGGGAAATGAGTTTGGGCATCCTGGTCAGTCTTTACAACATTATTGCATTCTGCATG
GTTGTGATTTACTGTAATTTGAACCATGCTTTGTTTTCACATTGTATGTATTATGTAATCTG
TTGCTTCCAAGGAGGAAGTTAACTTCTATTTACTTGGCAGAATGGATAGATTTTCCAAGAGG
TCCGCAAACTCTTCCAACCGGCAAAGTTCTCCCTGGAAATAACAATAGTTATGATAAATGCC
GCCGTAGATTTGATCTTGTAAGTTTTAGCTGTGCTCTTACGTTCCCTCACTAGATCTTTATT
GGCTATTTATTTCTTGATGAAATCATAATGTTTGTTGATCAACATTGCTTTTGTAGTTTTGT
AGACGTTAACATAAATATGTGTTAAGAGTTATTGATCATTAAGAATATCATGATTTTTTTG
TAGGGAGATGCAGATTTTCTTAGATATCGTGGTATGCAAGAGTTCGACCAGGCAATGCAGCA
TCTTGAGGAAAAATATGGGGTATGTCAGTATGTCACTGGTTTGTCTTTGTTGCATAGCAAGT
CACAGTTTAACGCCAGTCTCTTCAAATGGTCAAAAAGTGTAGAATTAATTCCTGTAATGAGA
TGAAAACTGCGCAAAGGCGGGAGCTGGAATTGCTTTTCACCAATTAAAACTATTTTCTTAAG
CGATTGTGTATTGATACCTATACCAACACTGACAATGTAACTGCAGTTTATGACATCTGAGC
ACCAGTATGTTTCACGGAAACATGAGGAAGATAAGGTGATCATCTTCGAAAGAGGAGATTTG
GTATTTGTTTTCAACTTCCACTGGAGCAATAGCTTTTTTGACTACCGTGTTGGGTGTTCCAA
GCCTGGGAAGTACAAGGTATGCTTGCCTTTTCATTGCCCACCCTTCACCAGTAGGGTTAGTG
GGGGCTTCTACAACTTTTAATTCCACATGTAGAGTTTGTTGTTCGTGCAGCTATCAATATAA
AGAATAGGATAATTTGTAAAGAAAAGAATTTGTTGCTCGAGATGTTGTAGTCATATAACATC
CCCGAAGCACATCTACTATTCATTCATATTATCTACTTAAGGGTTTGTTACAATCTTTGTAC
TCAGTTGGACTCACTCTAATACTGGAACTATTTACCGAATCTACCCTAATCATCCTAGCAGT
TTTAGAGCAGCCCCATTTGGACAGTCCACTGGGTTTAGTTGGTTTGTGACAGTTTCTGCTAT
TTCTTAATCAGGTGGCCTTAGACTCCGACGATGCACTCTTTGGTGGATTCAGCAGGCTTGAT
CATGATGTCGACTACTTCACAACCGTAAGTCTGGGCTCAAGCGTCACTTGACTCGTCTAGAC
TCAACTGCTTACAAATCTGAATCAACCTCCCATTTGCTGATGCCCTTGCAGGAACATCCGCA
TGACAATAGGCCGCGCTCTTTCTTGGTGTACACTCCTAGCAGAACTGCGGTCGTGTATGCCC
TTACAGAGTAAGAACCAGCAGCGGCTTGTTACAAGGCAAAGAGAGAACTCCAGGGAGCTCGT
```

-continued

```
GGATTGTGAGCGAAGCGACGGGCAACTGCGTGAGGCTGCTCTAAGCGCCATGACTGGGAGGG

GATCGTGCCTCTTCCCCTGATGCCAGGAGGATCAGATGGATAGGTAGCTTGTTGGTGAGCGC

TCGAAAGAAAATGGACGGGCCTGGGTGTTTGTCGTGCTGCACTTAACCCTCCTCCTATGTTG

CACATTCCCGGGTGTTTTTGTACATATAACTAATAATTGCCCGTGCGCTTCAACATGAACAT

ATAAATATTCTATATAATAGGTTATCCCGTGATTTACCTGCCGATA
```

A representative example of a naturally occurring *T. aestivum* SBEIIa nucleotide sequence from the D genome is shown in SEQ ID NO:5082:

```
                                            (SEQ ID NO: 5082)
CAGCGTCGCCTCCACCGTCCGTCCGTCGCTCTCTGCCACCTCTGCTGTGCGCGCGCACGAGG

GAGGAAGACGACGCCGCACACACACTCACACACGGCACACTCCCCGTGGGTCCCCTTTCCGG

CTCGGCGTCTATCTCCTCTCCCCCGCCCATCCCCATGCACTGCACCGTACCCGCCAGCTTCC

ACCCCCGCCGCACACGTTGCTCCCCCTTCTCATCGCTTCTCAATTAATATCTCCATCACTCG

GGTTCCGCGCTGCATTTCGGCCGGCGGGTTGAGTGAGATCTGGGCGACTGGCTGACTCAATC

ACTACGCGGGGATGGCGACGTTCGCGGTGTCCGGCGCGACTCTCGGTGTGGCGCGGGCCGGC

GTCGGAGTGGCGCGGGCCGGCTCGGAGCGGAGGGGCGGGGCGGACTTGCCGTCGCTGCTCCT

CAGGAAGAAGGACTCCTCTCGTACGCCTCGCTCTCTCGAATCTCCCCGTCTGGCTTTGGCTC

CCCTTCTCTCTCCTCTGCGCGCGCATGGCCTGTTCGATGCTGTTCCCCAATTGATCTCCATG

AGTGAGAGAGATAGCTGGATTAGGCGATCGCGCTTCCTGAACCTGTATTTTTTCCCCGCGG

GGAAATGCGTTAGTGTCACCCAGGCCCTGGTGTTACCACGGCTTTGATCATTCCTCGTTTCA

TTCTGATATATATTTTCTCACTCTTTTTCTTCCTGTTCTTGCTGTAACTGCAAGTTGTGGCG

TTTTTTCACTATTGTAGTCATCCTTGCATTTTGCAGGCGCCGTCCTGAGCCGCGCGGCCTCT

CCAGGGAAGGTCCTGGTGCCTGACGGCGAGAGCGACGACTTGGCAAGTCCGGCGCAACCTGA

AGAATTACAGGTACACACACTCGTGCCGGTAAATCTTCATACAATCGTTATTCACTTACCAA

ATGCCGGATGAAACCAACCACGGATGCGTCAGGTTTCGAGCTTCTTCTATCAGCATTGTGCA

GTACTGCACTGCCTTGTTCATTTTGTTAGCCTTGGCCCCGTGCTGGCTCTTGGGCCACTGAA

AAAATCAGATGGATGTGCATTCTAGCAAGAACTTCACAACATAATGCACCGTTTGGGGTTTC

GTCAGTCTGCTCTACAATTGCTATTTTTCGTGCTGTAGATACCTGAAGATATCGAGGAGCAA

ACGGCGGAAGTGAACATGACAGGGGGGACTGCAGAGAAACTTCAATCTTCAGAACCGACTCA

GGGCATTGTGGAAACAATCACTGATGGTGTAACCAAAGGAGTTAAGGAACTAGTCGTGGGGG

AGAAACCGCGAGTTGTCCCAAAACCAGGAGATGGGCAGAAAATATACGAGATTGACCCAACA

CTGAAAGATTTTCGGAGCCATCTTGACTACCGGTAATGCCTACCCGCTGCTTTCGCTCATTT

TGAATTAAGGTCCTTTCATCATGCAAATTTGGGGAACATCAAAGAGACAAAGACTAGGGACC

ACCATTTCATACAGATCCCCTCGTGGTCTGAGAATATGCTGGGAAGTAAATGTATAATTGAT

GGCTACAATTTGCTCAAAATTGCAATACGAATAACTGTCTCCGATCATTACAATTAAAGAGT

GGCAAACTGATGAAAATGTGGTGGATGGGTTATAGATTTTACTTTGCTAATTCCTCTACCAA

ATTCCTAGGGGGGAAATCTACCAGTTGGGAAACTTAGTTTCTTATCTTTGTGGCCTTTTTGT

TTTGGGGAAAACACATTGCTAAATTCGAATGATTTTGGGTATACCTCGGTGGATTCAACAGA

TACAGCGAATACAAGAGAATTCGTGCTGCTATTGACCAACATGAAGGTGGATTGGAAGCATT

TTCTCGTGGTTATGAAAAGCTTGGATTTACCCGCAGGTAAATTTAAAGCTTTATTATTATGA
```

```
-continued
AACGCCTCCACTAGTCTAATTGCATATCTTATAAGAAAATTTATAATTCCTGTTTTCCCCTC

TCTTTTTTCCAGTGCTGAAGGTATCGTCTAATTGCATATCTTATAAGAAAATTTATATTCCT

GTTTTCCCCTATTTTCCAGTGCTGAAGGTATCACTTACCGAGAATGGGCTCCTGGAGCGCAT

GTATGTCTTTTAAGTCTTAACAGACACCTTCCAATTTATTGTTAATGGTCACTATTCACCAA

CTAGCTTACTGGACTTACAAATTAGCTTACTGAATACTGACCAGTTACTATAAATTTATGAT

CTGGCTTTTGCACCCTGTTACAGTCTGCAGCATTAGTAGGTGACTTCAACAATTGGAATCCA

AATGCAGATGCTATGACCAGAGTATGTCTACAGCTTGGCAATTTTCCACCTTTGCTTCATAA

CTACTGATACATCTATTTGTATTTATTTAGCTGTTTGCACATTCCTTAAAGTTGAGCCTCAA

CTACATCATATCAAAATGGTATAATTTGTCAGTGTCTTAAGCTTCAGCCCAAAGATTCTACT

GAATTTAGTCCATCTTTTTGAGATTGAAAATGAGTATATTAAGGATGAATGAATACGTGCAA

CACTCCCATCTGCATTATGTGTGCTTTTCCATCTACAATGAGCATATTTCCATGCTATCAGT

GAAGGTTTGCTCCTATTGATGCAGATATTTGATATGGTCTTTTCAGGATGATTATGGTGTTT

GGGAGATTTTCCTCCCTAACAACGCTGATGGATCCTCAGCTATTCCTCATGGCTCACGTGTA

AAGGTAAGCTGGCCAATTATTTAGTCGAGGATGTAGCATTTTCGAACTCTGCCTACTAAGGG

TCCCTTTTCCTCTCTGTTTTTTAGATACGGATGGATACTCCATCCGGTGTGAAGGATTCAAT

TTCTGCTTGGATCAAGTTCTCTGTGCAGGCTCCAGGTGAAATACCTTTCAATGGCATATATT

ATGATCCACCTGAAGAGGTAAGTATCGATCTACATTACATTATTAAATGAAATTTCCAGTGT

TACAGTTTTTTAATACCCACTTCTTACTGACATGTGAGTCAAGACAATACTTTTGAATTTGG

AAGTGACATATGCATTAATTCACCTTCTAAGGGCTAAGGGGCAACCAACCTTGGTGATGTGT

GTATGCTTGTGTGTGACATAAGATCTTATAGCTCTTTTATGTGTTCTCTGTTGGTTAGGATA

TTCCATTTTGGCCTTTTGTGACCATTTACTAAGGATATTTACATGCAAATGCAGGAGAAGTA

TGTCTTCCAACATCCTCAACCTAAACGACCAGAGTCACTAAGGATTTATGAATCACACATTG

GAATGAGCAGCCCGGTATGTCAATAAGTTATTTCACCTGTTTCTGGTCTGATGGTTTATTCT

ATGGATTTTCTAGTTCTGTTATGTACTGTTAACATATTACATGGTGCATTCACTTGACAACC

TCGATTTTATTTTCTAATGTCTTCATATTGGCAAGTGCAAAACTTTGCTTCCTCTTTGTCTG

CTTGTTCTTTTGTCTTCTGTAAGATTTCCATNNNNNNNNNNNNNNNNNNNNNNNNNNNNNN

NNNNNNNNNNNNNNNNNNNNNNNNNNNNNNNNNNNNNNNNNNNNNNNNNNNNNNNNNNNN

NNNNNNNGGGGGGGGGGGGGGGGGGGTAGCGTTCTGTATTCTGCGAGCGATTCAAAAACTT

CCATTGTTCTGAGGTGTACGTACTGCAGGGATCTCCCATTATGAAGAGGATATAGTTAATTC

TTTGTAACCTACTTGGAAACTTGAGTCTTGAGGCATCGCTAATATATACTATCATCACAATA

CTTAGAGGATGCATCTGAATATTTTAGTGTGATCTTGCACAGGAACCGAAGATAAATTCATA

TGCTAATTTTAGGGATGAGGTGTTGCCAAGAATTAAAAGGCTTGGATACAATGCAGTGCAGA

TAATGGCAATCCAGGAGCATTCATACTATGCAAGCTTTGGGTATTCACACAATCCATTTTTT

TCTGTATACACCTCTTCACCCATTTGGAGCTATTACATCCTAATGCTTCATGCACATAAAAT

ATTTGGATATAATTCTTTATTAGATATATAGTACAACTACACTTAGTATTCTGACTTTTATG

ATCATTTTATTGTTGTTGGCTTGTTCCAGGTACCATGTTACTAATTTTTTTGCACCAAGTAG

CCGTTTTGGAACTCCAGAGGACTTAAAATCCTTGATCGATAGAGCACATGAGCTTGGTTTGC

TTGTTCTTATGGATATTGTTCATAGGTAATTAGTCCAATTTAATTTTAGCTGTTTTACTGTT

TATCTGGTATTCTAAAGGGAAAATCAGGCAATTATGATACATTGTCAAAAGCTAAGAGTGGC

GAAAGTGAAATGTCAAAATCTAGAGTGGCATAAGGAAAATTGGCAAAAACTAGTGGCAAAAA

TAAAATTTTCCCATCCTAAATGGCAGGGCCCTATCGCCGAATATTTTTCCATTCTATATAAT
```

```
TGTGCTACGTGACTTCTTTTTTCTCAGATGTATTAAACCAGTTGGACATGAAATGTATTTGG

TACATGTAGTAAACTGACAGTTCCATAGAATATCGTTTTGTAATGGCAACACAATTTGATGC

CATAGATGTGGATTGAGAAGTTCAGATGCTATCAATAGAATTAATCAACTGGCCATGTACTC

GTGGCACTACATATAGTTTGCAAGTTGGAAAACTGACAGCAATACCTCACTGATAAGTGGCC

AGGCCCCACTTGCCAGCTTCATACTAGATGTTACTTCCCTGTTGAATTCATTTGAACATATT

ACTTAAAGTTCTTCATTTGTCCTAAGTCAAACTTCTTTAAGTTTGACCAAGTCTATTGGAAA

ATATATCAACATCTACAACACCAAATTACTTTGATCAGATTAACAATTTTTATTTTATTATA

TTAGCACATCTTTGATGTTGTAGATATCAGCACATTTTTCTATAGACTTGGTCAAATATAGA

GAAGTTTGACTTAGGACAAATCTAGAACTTCAATCAATTTGGATCAGAGGGAACATCAAATA

ATATAGATAGATGTCAACACTTCAACAAAAAAATCAGACCTTGTCACCATATATGCATCAGA

CCATCTGTTTGCTTTAGCCACTTGCTTTCATATTTATGTGTTTGTACCTAATCTACTTTTCC

TTCTACTTGGTTTGGTTGATTCTATTTCAGTTGCATTGCTTCATCAATGATTTTGTGTACCC

TGCAGTCATTCGTCAAATAATACCCTTGACGGTTTGAATGGTTTCGATGGCACTGATACACA

TTACTTCCACGGTGGTCCACGCGGCCATCATTGGATGTGGGATTCTCGTCTATTCAACTATG

GGAGTTGGGAAGTATGTAGCTCTGACTTCTGTCACCATATTTGGCTAACTGTTCCTGTTAAT

CTGTTCTTACACATGTTGATATTCTATTCTTATGCAGGTATTGAGATTCTTACTGTCAAACG

CGAGATGGTGGCTTGAAGAATATAAGTTTGATGGATTTCGATTTGATGGGGTGACCTCCATG

ATGTATACTCACCATGGATTACAAGTAAGTCATCAAGTGGTTTCAGTAACTTTTTTAGGGCA

CTGAAACAATTGCTATGCATCATAACATGTATCATGATCAGGACTTGTGCTACGGAGTCTTA

GATAGTTCCCTAGTATGCTTGTACAATTTTACCTGATGAGATCATGGAAGATTGGAAGTGAT

TATTATTTATTTTCTTTCTAAGTTTGTTTCTTGTTCTAGATGACATTTACTGGGAACTATGG

CGAATATTTTGGATTTGCTACTGATGTTGATGCGGTAGTTTACTTGATGCTGGTCAACGATC

TAATTCATGGACTTTATCCTGATGCTGTATCCATTGGTGAAGATGTAAGTGCTTACAGTATT

TATGATTTTTAACTAGTTAAGTAGTTTTATTTTGGGGATCAGTCTGTTACACTTTTTGTTAG

GGGTAAAATCTCTCTTTTCATAACAATGCTAATTTATACCTTGTATGATAATGCATCACTTA

GGTAATTTGAAAAGTGCAAGGGCATTCAAGCTTACGAGCATATTTTTTGATGGCTGTAATTT

ATTTGATAGTATGCTTGTTTGGGTTTTTCAATAAGTGGGAGTGTGTGACTAATGTTGTATTA

TTTATTTAATTGCGGAAGAAATGGGCAACCTTGTCAATTGCTTCAGAAGGCTAACTTTGATT

CCATAAACGCTTTGGAAATGAGAGGCTATTCCCAAGGACATGAATTATACTTCAGTGTGTTC

TGTACATGTATTTGTAATAGTGGTTTAACTTAAATTCCTGCACTGCTATGGAATCTCACTGT

ATGTTGTTAGTGTACACATCCACAAACAAGTAATCCTGAACTTTCAACTCATGAGAAAATAG

GAGGTTCCGCTTCTGCCAGCATTAACTGTTCACAGTTCTAATTTGTGTAACTGTGAAATTGT

TCAGGTCAGTGGAATGCCTACATTTTGCATCCCTGTTCCAGATGGTGGTGTTGGTTTTGACT

ACCGCCTGCATATGGCTGTAGCAGATAAATGGATTGAACTCCTCAAGTAAGTGCAGGAATAT

TGGTGATTACATGCGCACAATGATCTAGATTACATTTTCTAAATGGTAAAAAGGAAAATATG

TATGTGAATATCTAGACATTTGCCTGTTATCAGCTTGAATACGAGAAGTCAAATACATGATT

TAAATAGCAAATCTCGGAAATGTAATGGCTAGTGTCTTTATGCTGGGCAGTGTACATTGCGC

TGTAGCAGGCCAGTCAACACAGTTAGCAATATTTTCAGAAACAATATTATTTATATCCGTAT

ATGAGGAAAGTAGGTATATAAACTGTGGTCATTAATTGTGTTCACCTTTTGTCCTGTTTAAG

GATGGGCAGTAGGTAATAAATTTAGCCAGATAAAATAAATCGTTATTAGGTTTACAAAAGGA
```

-continued

```
ATATACAGGGTCATGTAGCATATCTAGTTGTAATTAATGAAAAGGCTGACAAAAGGCTCGGT

AAAAAAAACTTTATGATGATCCAGATAGATATGCAGGAACGCGACTAAAGCTCAAATACTTA

TTGCTACTACACAGCTGCCAATCTGTCATGATCTGTGTTCTGCTTTGTGCTATTTAGATTTA

AATACTAACTCGATACATTGGCAATAATAAACTTAACTATTCAACCAATTTGGTGGATACCA

GAGATTTCTGCCCTCTTGTAGTAATGATGTGCTCCTGCTGCTGTTCTCTGCCGTTACAAAAG

CTGTTTTCAGTTTTTTGCATCATTATTTTTGTGTGTGAGTAGTTTAAGCATGTTTTTTGAAG

CTGTGAGCTGTTGGTACTTAATACATTCTTGGAAGTGTCCAAATATGCTGCAGTGTAATTTA

GCATTTCTTTAACACAGGCAAAGTGACGAATCTTGGAAAATGGGCGATATTGTGCACACCCT

AACAAATAGAAGGTGGCTTGAGAAGTGTGTAACTTATGCAGAAAGTCATGATCAAGCACTAG

TTGGTGACAAGACTATTGCATTCTGGTTGATGGATAAGGTACTAGCTGTTACTTTTGGACCA

AAAGAATTACTCCCTCCGTTCCTAAATATAAGTCTTTGTAGAGATTCCACTATGGACCACAT

AGTATATAGATGCATTTTAGAGTGTAGATTCACTCATTTTGCTTCGTATGTAGTCCATAGTG

AAATCTCTACAGAGACTTATATTTAGGAACGGAGGGAGTACATAATTGATTTGTCTCATCAG

ATTGCTAGTGTTTTCTTGTGATAAAGATTGGCTGCCTCACCCATCACCAGCTATTTCCCAAC

TGTTACTTGAGCAGAATTTGCTGAAAACGTACCATGTGGTACTGTGGCGGCTTGTGAACTTT

GACAGTTATGTTGCAATTTTCTGTTCTTATTTATTTGATTGCTTATGTTACCGTTCATTTGC

TCATTTCTTTCCGAGACCAGCCAAAGTCACGTGTAGCTGTGTGATCTGTTATCTGAATCTTG

AGCAAATTTTATTAATAGGCTAAAATCCAACGAATTATTTGCTTGAATTTAAATATACAGAC

GTATAGTCACCTGGCTCTTTCTTAGATGATTACCATAGTGCCTGAAGGCTGAAATAGTTTTG

GTGTTTCTTGGATGCCGCCTAAAGGAGTGATTTTTATTGGATAGATTCCTGGCCGAGTCCTC

GTTACAACATACATTTTGGAGATATGCTTAGTAACAGCTCTGGGAAGTTTGGTCACAAGTCT

GCATCTACACGCTCCTTGAGGTTTTATTATGGCGCCATCTTTGTAACTAGTGGCACCTGTAA

GGAAACACATTCAAAAGGAAACGGTCACATCATTCTAATCAGGACCACCATACTAAGAGCAA

GATTCTGTTCCAATTTTATGAGTTTTTGGGACTCCAAAGGGAACAAAAGTGTCTCATATTGT

GCTTATAACTACAGTTGTTTTTATACCAGTGTAGTTTTATTCCAGGACAGTTGATACTTGGT

ACTGTGCTGTAAATTATTTATCCGACATAGAACAGCATGAACATATCAAGCTCTCTTTGTGC

AGGATATGTATGATTTCATGGCTCTGGATAGGCCTTCAACTCCTCGCATTGATCGTGGCATA

GCATTACATAAAATGATCAGGCTTGTCACCATGGGTTTAGGTGGTGAAGGCTATCTTAACTT

CATGGGAAATGAGTTTGGGCATCCTGGTCAGTCTTTACAACATTATTGCATTCTGCATGATT

GTGATTTACTGTAATTTGAACCATGCTTTTCTTTCACATTGTATGTATTATGTAATCTGTTG

CTTCCAAGGAGGAAGTTAACTTCTATTTACTTGGCAGAATGGATAGATTTTCCAAGAGGCCC

ACAAACTCTTCCAACCGGCAAAGTTCTCCCTGGAAATAACAATAGTTATGATAAATGCCGCC

GTAGATTTGATCTTGTAAGTTTTAGCTGTGCTATTACATTCCCTCACTAGATCTTTATTGGC

CATTTATTTCTTGATGAAATCATAATGTTTGTTAGGAAAGATCAACATTGCTTTTGTAGTTT

TGTAGACGTTAACATAAGTATGTGTTGAGAGTTGTTGATCATTAAAAATATCATGATTTTTT

GCAGGGAGATGCAGATTTTCTTAGATATCGTGGTATGCAAGAGTTCGATCAGGCAATGCAGC

ATCTTGAGGAAAAATATGGGGTATGTCACTGGTTTGTCTTTGTTGCATAACAAGTCACAGTT

TAACGTCAGTCTCTTCAAGTGGTAAAAAAAGTGTAGAATTAATTCCTGTAATGAGATGAAAA

CTGTGCAAAGGCGGAGCTGGAATTGCTTTTCACCAAAACTATTTTCTTAAGTGCTTGTGTAT

TGATACATATACCAGCACTGACAATGTAACTGCAGTTTATGACATCTGAGCACCAGTATGTT

TCACGGAAACATGAGGAAGATAAGGTGATCATCTTCGAAAGAGGAGATTTGGTATTTGTTTT
```

-continued

```
CAACTTCCACTGGAGCAATAGCTTTTTTGACTACCGTGTTGGGTGTTCCAAGCCTGGGAAGT

ACAAGGTATGCTTGCCTTTTCATTGTCCACCCTTCACCAGTAGGGTTAGTGGGGGCTTCTAC

AACTTTTAATTCCACATGGATAGAGTTTGTTGGTCGTGCAGCTATCAATATAAAGAATAGGG

TAATTTGTAAAGAAAAGAATTTGCTCGAGCTGTTGTAGCCATAGGAAGGTTGTTCTTAACAG

CCCCGAAGCACATACCATTCATTCATATTATCTACTTAAGTGTTTGTTTCAATCTTTATGCT

CAGTTGGACTCGGTCTAATACTAGAACTATTTTCCGAATCTACCCTAACCATCCTAGCAGTT

TTAGAGCAGCCCCATTTGGACAATTGGCTGGGTTTTTGTTAGTTGTGACAGTTTCTGCTATT

TCTTAATCAGGTGGCCTTGGACTCCGACGATGCACTCTTTGGTGGATTCAGCAGGCTTGATC

ATGATGTCGACTACTTCACAACCGTAAGTCTGGGCTCAAGCGTCACTTGACTCGTCTTGACT

CAACTGCTTACAAATCTGAATCAACTTCCCAATTGCTGATGCCCTTGCAGGAACATCCGCAT

GACAACAGGCCGCGCTCTTTCTCGGTGTACACTCCGAGCAGAACTGCGGTCGTGTATGCCCT

TACAGAGTAAGAACCAGCAGCGGCTTGTTACAAGGCAAAGAGAGAACTCCAGAGAGCTCGTG

GATCGTGAGCGAAGCGACGGGCAACGGCGCGAGGCTGCTCCAAGCGCCATGACTGGGAGGGG

ATCGTGCCTCTTCCCCAGATGCCAGGAGGAGCAGATGGATAGGTAGCTTGTTGGTGAGCGCT

CGAAAGAAAATGGACGGGCCTGGGTGTTTGTTGTGCTGCACTGAACCCTCCTCCTATCTTGC

ACATTCCCGGTTGTTTTTGTACATATAACTAATAATTGCCCGTGCGCTTCAACATGAACATA

TAAATATTCTAATAGGTTATCCCGTGATTTACCTGCCTAT
```

The SBEIIa amino acid sequence encoded by the *T. aestivum* (cultivar Chinese Spring) SBEIIa gene A genome is set forth in SEQ ID NO:2 (GENBANK® accession CCD41775.1):

```
                                           (SEQ ID NO: 2)
MATFAVSGATLGVARPAGAGGGLLPRSGSERRGGVDLPSLLLRKKDSSRA

VLSRAASPGKVLVPDGESDDLASPAQPEELQIPEDIEEQTAEVNMIGGTA

EKLESSEPTQGIVETITDGVTKGVKELVVGEKPRVVPKPGDGQKIYEIDP

TLKDFRSHLDYRYSEYRRIRAAIDQHEGGLEAFSRGYEKLGFTRSAEGIT

YREWAPGAHSAALVGDFNNWNPNADTMTRDDYGVWEIFLPNNADGSPAIP

HGSRVKIRMDTPSGVKDSISAWIKFSVQAPGEIPFNGIYYDPPEEEKYVF

QHPQPKRPESLRIYESHIGMSSPEPKINSYANFRDEVLPRIKRLGYNAVQ

IMAIQEHSYYASFGYHVTNFFAPSSRFGTPEDLKSLIDRAHELGLLVLMD

IVHSHSSNNTLDGLNGFDGIDTHYFHGGPRGHHWMWDSRLENYGSWEVLR

ELLSNARWWLEEYKEDGFREDGVTSMMYTHHGLQMTFTGNYGEYFGFATD

VDAVVYLMLVNDLIHGLYPDAVSIGEDVSGMPTFCIPVPDGGVGFDYRLH

MAVADKWIELLKQSDESWKMGDIVHILTNRRWLEKCVTYAESHDQALVGD

KTIAFWLMDKDMYDFMALDRPSTPRIDRGIALHKMIRLVTMGLGGEGYLN

FMGNEFGHPEWIDFPRGPQTLPTGKVLPGNNNSYDKCRRRFDLGDADFLR

YRGMQEFDQAMQHLEEKYGFMTSEHQYVSRKHEEDKVIIFERGDLVFVFN

FHWSNSFFDYRVGCSRPGKYKVALDSDDALFGGFSRLDHDVDYFTTEHPH

DNRPRSFSVYTPSRTAVVYALTE
```

The *Triticum* plants, cells, plant parts, grains, and progeny thereof that are provided herein have a mutation in at least two endogenous SBEII alleles, such that expression of the SBEIIa or SBEIIb genes is reduced or completely inhibited, or the activity of the SBEIIa enzyme or SBEIIb enzyme is lost. Thus, the plants, cells, plant parts, grains, and progeny exhibit higher levels of amylose.

The term "rare-cutting endonucleases" as used herein refers to natural or engineered proteins having endonuclease activity directed to nucleic acid sequences with a recognition sequence (target sequence) about 12-40 bp in length (e.g., 14-40, 15-36, or 16-32 bp in length). Several rare-cutting endonucleases cause cleavage inside their recognition site, leaving 4 nt staggered cuts with 3'OH or 5'OH overhangs. These rare-cutting endonucleases may be meganucleases, such as wild type or variant proteins of homing endonucleases, more particularly belonging to the dodecapeptide family (LAGLIDADG (SEQ ID NO:3); see, WO 2004/067736), or may be fusion proteins containing a DNA binding domain and a catalytic domain with cleavage activity. TALE nucleases and zinc-finger-nucleases (ZFN) are examples of fusions of DNA binding domains with the catalytic domain of the FokI endonuclease. Customized TALE nucleases are commercially available under the trade name TALEN™ (Cellectis, Paris, France). For a review of rare-cutting endonucleases, see Baker, *Nature Methods* 9:23-26, 2012. Additional rare-cutting endonucleases can be used in the methods disclosed herein are known as "Mega-TAL" nucleases, and include a fusion of a TALE binding domain with a meganuclease (see, e.g., EP3320910 and Boissel et al., *Nucl Acids Res* 42(4):2591-2601, 2014). RNA-guided endonucleases referred to as Cas9 or Cpf1 systems also can be used, as described further below (see, also, Begemann et al., *Scientific Reports* 7:11606, 2017).

"Mutagenesis" as used herein refers to processes in which mutations are introduced into a selected DNA sequence. Mutations induced by endonucleases generally are obtained by a double strand break, which results in insertion/deletion mutations ("indels") that can be detected by deep-sequencing analysis. Such mutations typically are deletions of several base pairs, and have the effect of inactivating the mutated allele. Mutations also can be introduced by generating two double-strand breaks on the same chromosome, resulting in either two indels or the deletion/inversion of intervening sequence. In the methods described herein, for example, mutagenesis occurs via double stranded DNA breaks made by TALE nuclease pairs targeted to selected DNA sequences in a plant cell. Such mutagenesis results in "TALE nuclease-induced mutations" (e.g., TALE nuclease-induced knockouts) and reduced expression of the targeted gene, or reduced activity of the SBEII protein. Following mutagenesis, plants can be regenerated from the treated cells using known techniques (e.g., planting seeds in accordance with conventional growing procedures, followed by self-pollination).

The plants, plant cells, plant parts, grains, and progeny provided herein can be generated using a TALE nuclease system to make targeted mutations in SBEII alleles. Thus, this document provides materials and methods for using rare-cutting endonucleases (e.g., TALE nucleases) to generate *Triticum* plants and related products (e.g., grains and plant parts) that can be used to make flour with high amylose, due to mutations in the SBEII alleles. Other sequence-specific nucleases also may be used to generate the desired plant material, including engineered homing endonucleases, zinc finger nucleases, and RNA-guided endonucleases.

The term "expression" as used herein refers to the transcription of a particular nucleic acid sequence to produce sense or antisense RNA or mRNA, and/or the translation of an mRNA molecule to produce a polypeptide, with or without subsequent post-translational events.

"Reducing the expression" or "reduced expression" of a gene or polypeptide in a plant or a plant cell includes inhibiting, interrupting, knocking-out, or knocking-down the gene or polypeptide, such that transcription of the gene and/or translation of the encoded polypeptide is reduced as compared to a corresponding control plant or plant cell in which expression of the gene or polypeptide is not inhibited, interrupted, knocked-out, or knocked-down. Expression levels can be detected and/or measured using methods such as, for example, reverse transcription-polymerase chain reaction (RT-PCR), Northern blotting, dot-blot hybridization, in situ hybridization, nuclear run-on and/or nuclear run-off, RNase protection, or immunological and enzymatic methods such as ELISA, radioimmunoassay, and western blotting.

In general, a mutant *Triticum* plant, plant part, or plant cell as provided herein can have its expression of SBEII alleles reduced by more than 60 percent (e.g., by more than 70 percent, more than 80 percent, or more than 90 percent) as compared to a control *Triticum* plant that lacks the mutation(s). The control *Triticum* plant can be, for example, a wild-type *Triticum* plant in which the SBEII alleles have not been mutated.

In some embodiments, a mutant *Triticum* plant, plant part, or plant cell can contain a mutation in an SBEII nucleic acid having a sequence with at least 90 percent identity to a representative SBEII nucleotide sequence. For example, a mutation can be in a nucleotide sequence with at least 91 percent, at least 92 percent, at least 93 percent, at least 94 percent, at least 95 percent, at least 96 percent, at least 97 percent, at least 98 percent, or at least 99 percent sequence identity to a representative, naturally occurring SBEII nucleotide sequence.

In some cases, a mutation can be at a target sequence as set forth in an SBEIIa coding sequence as set forth herein (e.g., SEQ ID NO:1), or at a target sequence that is at least 90 percent (e.g., at least 92 percent, at least 94 percent, at least 96 percent, at least 97 percent, at least 98 percent, or at least 99 percent) identical to the sequence set forth in an SBEIIa sequence as set forth herein (e.g., SEQ ID NO:1).

The percent sequence identity between a particular nucleic acid or amino acid sequence and a sequence referenced by a particular sequence identification number is determined as follows. First, a nucleic acid or amino acid sequence is compared to the sequence set forth in a particular sequence identification number using the BLAST 2 Sequences (Bl2seq) program from the stand-alone version of BLASTZ containing BLASTN version 2.0.14 and BLASTP version 2.0.14. This stand-alone version of BLASTZ can be obtained online at fr.com/blast or at ncbi.nlm.nih.gov. Instructions explaining how to use the Bl2seq program can be found in the readme file accompanying BLASTZ. Bl2seq performs a comparison between two sequences using either the BLASTN or BLASTP algorithm. BLASTN is used to compare nucleic acid sequences, while BLASTP is used to compare amino acid sequences. To compare two nucleic acid sequences, the options are set as follows: -i is set to a file containing the first nucleic acid sequence to be compared (e.g., C:\seq1.txt); -j is set to a file containing the second nucleic acid sequence to be compared (e.g., C:\seq2.txt); -p is set to blastn; -o is set to any desired file name (e.g., C:\output.txt); -q is set to -1; -r is set to 2; and all other options are left at their default setting. For example, the following command can be used to generate an output file containing a comparison between two sequences: C:\Bl2seq c:\seq1.txt -j c:\seq2.txt -p blastn -o c:\output.txt -q -1 -r 2. To compare two amino acid sequences, the options of Bl2seq are set as follows: -i is set to a file containing the first amino acid sequence to be compared (e.g., C:\seq1.txt); -j is set to a file containing the second amino acid sequence to be compared (e.g., C:\seq2.txt); -p is set to blastp; -o is set to any desired file name (e.g., C:\output.txt); and all other options are left at their default setting. For example, the following command can be used to generate an output file containing a comparison between two amino acid sequences: C:\Bl2seq c:\seq1.txt -j c:\seq2.txt -p blastp -o c:\output.txt. If the two compared sequences share homology, then the designated output file will present those regions of homology as aligned sequences. If the two compared sequences do not share homology, then the designated output file will not present aligned sequences.

Once aligned, the number of matches is determined by counting the number of positions where an identical nucleotide or amino acid residue is presented in both sequences. The percent sequence identity is determined by dividing the number of matches either by the length of the sequence set forth in the identified sequence (e.g., SEQ ID NO:1), or by an articulated length (e.g., 100 consecutive nucleotides or amino acid residues from a sequence set forth in an identified sequence), followed by multiplying the resulting value by 100. For example, a nucleic acid sequence that has 9,500 matches when aligned with the sequence set forth in SEQ ID NO:1 is 96.0 percent identical to the sequence set forth in SEQ ID NO:1 (i.e., 9,500±9,893×100=96.0). It is noted that the percent sequence identity value is rounded to the nearest tenth. For example, 75.11, 75.12, 75.13, and 75.14 is rounded down to 75.1, while 75.15, 75.16, 75.17, 75.18, and 75.19 is rounded up to 75.2. It also is noted that the length value will always be an integer.

Methods for selecting endogenous target sequences and generating TALE nuclease pairs targeted to such sequences can be performed as described elsewhere. See, for example, PCT Publication No. WO 2011/072246, which is incorporated herein by reference in its entirety. In some embodiments, software that specifically identifies TALE nuclease recognition sites, such as TALE-NT 2.0 (Doyle et al., *Nucleic Acids Res* 40:W117-122, 2012) can be used.

Transcription activator-like (TAL) effectors are found in plant pathogenic bacteria of the genus *Xanthomonas*. These proteins play important roles in disease, or trigger defense, by binding host DNA and activating effector-specific host genes (see, e.g., Gu et al., *Nature* 435:1122-1125, 2005; Yang et al., *Proc Natl Acad Sci USA* 103:10503-10508, 2006; Kay et al. *Science* 318:648-651, 2007; Sugio et al., *Proc Natl Acad Sci USA* 104:10720-10725, 2007; and Romer et al. *Science* 318:645-648, 2007). Specificity depends on an effector-variable number of imperfect, typically 34 amino acid repeats (Schornack et al., *J Plant Physiol* 163:256-272, 2006; and WO 2011/072246). Polymorphisms are present primarily at repeat positions 12 and 13, which are referred to as the repeat variable-diresidue (RVD).

The RVDs of TAL effectors correspond to the nucleotides in their target sites in a direct, linear fashion, one RVD to one nucleotide, with some degeneracy and no apparent context dependence. This mechanism for protein-DNA recognition enables target site prediction for new target specific TAL effectors, as well as target site selection and engineering of new TAL effectors with binding specificity for the selected sites.

TAL effector DNA binding domains can be fused to other sequences, such as endonuclease sequences, resulting in chimeric endonucleases targeted to specific, selected DNA sequences, and leading to subsequent cutting of the DNA at or near the targeted sequences. Such cuts (i.e., double-stranded breaks) in DNA can induce mutations into the wild type DNA sequence via non-homologous end joining (NHEJ) or homologous recombination, for example. In some cases, TALE nucleases can be used to facilitate site directed mutagenesis in complex genomes, knocking out or otherwise altering gene function with great precision and high efficiency. As described in the Examples below, TALE nucleases targeted to the *T. aestivum* SBEII alleles can be used to mutagenize the endogenous alleles, resulting in plants without detectable expression (or reduced expression) of SBEII. The fact that some endonucleases (e.g., FokI) function as dimers can be used to enhance the target specificity of the TALE nuclease. For example, in some cases a pair of TALE nuclease monomers targeted to different DNA sequences can be used. When the two TALE nucleases recognition sites are in close proximity, the inactive monomers can come together to create a functional enzyme that cleaves the DNA. By requiring DNA binding to activate the nuclease, a highly site-specific restriction enzyme can be created.

Methods for using TALE nucleases to generate *Triticum* plants, plant cells, or plant parts having mutations in endogenous genes include, for example, those described in the Examples herein. For example, one or more nucleic acids encoding TALE nucleases targeted to conserved nucleotide sequences present in one or more SBEII alleles can be transformed into plant cells or plant parts (e.g., protoplasts or scutella), where they can be expressed. In some cases, one or more TALE nuclease proteins can be introduced into plant cells or plant parts (e.g., protoplasts or scutella). The cells or plant parts, or a plant cell line or plant part generated from the cells, can subsequently be analyzed to determine whether mutations have been introduced at the target site(s), through next-generation sequencing techniques (e.g., 454 pyrosequencing or Illumina sequencing). The template for sequencing can be, for example, a TALE nuclease target site within an SBEII gene sequence that is amplified by PCR (e.g., using primers that are homologous to conserved nucleotide sequences across all SBEII alleles).

RNA-guided rare-cutting endonucleases also can be used in the methods provided herein. For example, the clustered regularly interspaced short palindromic repeats/CRISPR-associated (CRISPR/Cas) systems use RNA to direct DNA cleavage (see, e.g., Belahj et al., *Plant Methods* 9:39, 2013). These systems can consist of a Cas9 or Cpf1 (Zetsche et al., *Nature Biotechnol* 35:31-34, 2017) endonuclease and a guide RNA (either a complex between a CRISPR RNA [crRNA] and trans-activating crRNA [tracrRNA], or a synthetic fusion between the 3' end of the crRNA and 5'end of the tracrRNA). The guide RNA directs Cas9 or Cpf1 binding and DNA cleavage to sequences that are adjacent to a proto-spacer adjacent motif (PAM; e.g., NGG for Cas9 from *Streptococcus pyogenes*). Once at the target DNA sequence, Cas9 or Cpf1 generates a DNA double-strand break at a position three nucleotides from the 3' end of the crRNA sequence that is complementary to the target sequence. As there are several PAM motifs present in the nucleotide sequence of the SBEII alleles, the CRISPR/Cas system may be employed to introduce mutations within the SBEII alleles within *Triticum* plant cells in which the Cas9 or Cpf1 endonuclease and the guide RNA are transfected and expressed. This approach can be used as an alternative to TALE nucleases in some instances, to obtain plants and plant parts as described herein.

The present document also provides wheat grain having an altered starch content as compared to the starch content in grain from corresponding wild-type wheat. The term "grain" as used herein refers to essentially mature grain. This includes grain harvested in a commercial setting. In some embodiments, the altered starch content is at least partly a consequence of reduced SBEIIa expression. In some embodiments, the grain has an increased proportion of amylose (as a percentage of total starch). This may be determined as a reduced proportion of amylopectin in the starch, compared to grain from a wild-type plant. Wild-type wheat starch typically contains about 20-30% amylose and 70-80% amylopectin. The grain provided herein can have a starch content that includes at least about 40% (w/w) amylose. In some embodiments, the activities of both SBEIIa and SBEIIb are reduced during development of the endosperm. In some embodiments, the proportion of amylose, as measured by methods understood in the art, for example, can be at least 40%, at least 55%, at least 60%, at least 65%, at least 70%, at least 75%, at least 80%, or at least 90% (w/w) of the total starch of the grain. Increased amylose levels may be evidenced by abnormal starch granule morphology, by loss of birefringence of the granules when observed under a light microscope, or by other suitable methods. In some embodiments, for example, the proportion of amylose can be measured using a potentiometric, amperometric, or colourimetric measurement of the iodine binding capacity of amylose in amylose-iodine inclusion complexes. Amylose content also can be measured by high-performance liquid chromatography (Batey and Curtin, *Starch* 48:338-344, 1996), or by specific precipitation of branched amylopectin with lectin concanavalin A (Con A) (Yun and Matheson, *Starch/Starke* 42:302-305, 1990), followed by colorimetric quantification of D-glucose in hydrolyzed amylose. The colorimetric quantification may include a spectrophotometric method such as, for example, the method of Morrison and Laignelet (*J Cereal Sci* 9-20, 1983).

The term "dietary fiber" as used herein includes the carbohydrate and carbohydrate digestion products that are not absorbed in the small intestine of healthy humans, but that enter the large bowel. This includes resistant starch and other soluble and insoluble carbohydrate polymers. It is intended to include that portion of carbohydrates that are fermentable, at least partially, in the large bowel by the resident microflora. The starch provided herein contains relatively high levels of dietary fiber, more particularly amylose. The dietary fiber content of the grain provided herein results at least in part from the increased amylose content in the starch of the grain, and also, or in combination with, an increased resistant starch content as a percentage of the total starch.

"Resistant starch" (RS) is defined herein as the sum of starch and products of starch digestion that are not absorbed in the small intestine of healthy humans but that enter into the large bowel. This is defined in terms of a percentage of the total starch of the grain, or a percentage of the total starch content in the food, according to the context. Thus, resistant starch excludes products digested and absorbed in the small intestine. Resistant starches include physically inaccessible starch (RSI form), resistant native starch granules (RS2), retrograded starches (RS3), and chemically modified starches (RS4). The altered starch structure and in particular the high amylose levels of the starch from the wheat provided herein give rise to an increase in resistant starch when consumed in food. The starch may be in an RSI form, being somewhat inaccessible to digestion. Starch-lipid association as measured by V-complex crystallinity is also likely to contribute to the level of resistant starch.

This document provides wheat grain with an altered resistant starch content, as a consequence of the increased proportion of amylose. Wild-type wheat seeds contain less than 2% of resistant starch in whole grain. The grain provided herein can have at least about 3%, at least about 4%, at least about 6%, at least about 8%, at least about 10%, at least about 12%, or at least about 14% resistant starch. The proportion of resistant starch can be indirectly measured by, for example, spectrophotometric quantification of D-glucose in hydrolyzed starch with alpha-amylase and pancreatic amyloglucosidase (see, e.g., Official Methods of Analysis of AOAC International (2005), 18th Ed., AOAC International, Gaithersburg, Maryland, USA, Official Method 2002.02).

The present document also provides wheat grain having an altered dietary fiber content as compared to wild type wheat grain. The altered dietary fiber content can be at least partly a consequence of increased amylose content due to reduced SBEIIa expression. Wild-type wheat seeds typically have a dietary fiber content from about 12% to about 15%. The grain provided herein can have a dietary fiber content of at least about 20%, at least about 25%, at least about 30%, or at least about 35% of the whole grain. The proportion of dietary fiber can be measured using, for example, the McCleary fiber method (Official Methods of Analysis of AOAC International, supra, Method 2011.25) for the determination of insoluble, soluble and total dietary fiber, inclusive of RS and dietary fiber that is not precipitated in 4 parts alcohol, 1 part water (SDFS/LMWSDF) with a degree of polymerization (DP)≥3, consistent with the CODEX definition adopted in 2009 (Codex, 2009.01). The proportion of dietary fiber also can be measured using the Lee method (Official Methods of Analysis of AOAC International, supra, Method 991.43).

In some embodiments, as illustrated in the Examples herein, this document provides methods for engineering wheat plants by introducing deletions or insertions into endogenous SBEIIa alleles using one or more rare-cutting endonucleases that specifically bind to at least one of SEQ ID NOS:6-8:

```
                                          (SEQ ID NO: 6)
TTCAGAACCGACTCAGGGCATTGTGGAAACAATCACTGATGGTGTAACC

A,
                                          (SEQ ID NO: 7)
TATACGAGATTGACCCAACGCTGAAAGATTTTCGGAGCCATCTTGACTA, and/or
                                          (SEQ ID NO: 8)
TCCTGAGCCGCGCGGCCTCTCCAGGGAAGGTCCTGGTGCCTGACGGCGA,
``` such that the rare-cutting endonuclease(s) target endogenous sequences encoding SBEII polypeptides that contain at least one of those sequences.

The modified plant cells can be regenerated into whole wheat plants that produce grains, which can be compared with the parental (wild type) plants from which they were derived. The grains resulting from the regenerated plants can be generally characterized by their simultaneous increase in total protein content and amylose content. The total protein content can be increased by about 5 to 20% or more (e.g., at least 5%, at least 10%, at least 15%, or at least 20%) as compared to the total protein content in corresponding wild type wheat. The amylose content (as a percentage of total starch) can be increased by about 5 to 50% or more (e.g., at least 5%, at least 10%, at least 15%, at least 20%, at least 25%, at least 30%, at least 35%, at least 40%, at least 45%, or at least 50%) as compared to the amylose content in wild type wheat. In addition, the amylopectin content (as a percentage % of total starch) can be decreased from about 5 to 40% or more (e.g., at least 10%, at least 15%, at least 20%, at least 25%, at least 30%, at least 35%, or at least 40%) as compared to the amylopectin content in wild type wheat. Further, in some cases, the total starch content can be decreased by about 5 to 20% (e.g., at least 5%, at least 10%, or at least 15%) as compared to the total starch content in wild type wheat.

This document also provides flour, meal, dough, and other products produced from or using the grain provided herein. These products may be unprocessed or processed, for example by fractionation or bleaching. This document further provides wheat grain useful for food production obtained from the wheat plant provided herein. Additionally, this document encompasses grain processed in other ways, so that the grain may have been milled, ground, rolled, pearled, kibbled or cracked, or par boiled (polenta).

The invention will be further described in the following examples, which do not limit the scope of the invention described in the claims.

EXAMPLES

Example 1—Engineering Sequence-Specific Nucleases to Mutagenize SBEIIa Alleles To attenuate or inactivate SBEIIa alleles in *Triticum* plants, sequence-specific nucleases were designed to target conserved nucleotides within the SBEIIa coding sequences. To identify conserved sequences within the SBEIIa homoeoalleles for TALE nuclease binding, partial sequences of the SBEIIa alleles on genomes A, B, and D were amplified by PCR using primers oNJB011 (5'-ACTCCTCTCGTACGCCTCGC; SEQ ID NO:4) and oNJB013 (5'-CCAATCCACCTTCATGTTGGTCA; SEQ ID NO:5). The nucleotide sequences of exons 2 and 3 of the SBEIIa genes are shown in FIG. 1. Numerous SNPs were identified between the SBEIIa-A, B and D homoeoalleles, making TALE nuclease design challenging. Three TALE nuclease target sites were chosen, and there was at least one nucleotide difference between the homoeoalleles at each target site. The predicted binding sites for TALE nucleases TaSBEIIa_T01, TaSBEIIa_T02 and TaSBEIIa_T03 were TATACGAGATTGACCCAACGCTGAAAGATTTTCG-GAGCCATCTTGACTA (SEQ ID NO:7), TTCAGAACCGACTCAGGGCATTGTGGAAACAAT CACTGATGGTGTAACCA (SEQ ID NO:6), and TCCT-GAGCCGCGCGGCCTCTCC AGGGAAGGTCCTGG-TGCCTGACGGCGA (SEQ ID NO:8), respectively. TALE nuclease pairs were synthesized using methods similar to those described elsewhere (Cermak et al., *Nucleic Acids Res* 39:e82, 2011; Reyon et al., *Nat Biotechnol* 30:460-465, 2012; and Zhang et al., *Nat Biotechnol* 29:149-153, 2011). The relative positions of the TALE nuclease target sites in a representative SBEIIa gene are shown in FIG. 2. The predicted nucleotide target sites of the TALE nucleases in each SBEIIa gene are shown in FIG. 3.

Example 2—Activity of SBEIIa TALE Nuclease Pairs at their Endogenous Target Sites in *T. aestivum*

To assess TALE nuclease activity at endogenous target sequences, TALE nuclease pairs are stably integrated into the wheat genome, and target sites are surveyed for mutations introduced by NHEJ. Methods for integrating DNA into the *Triticum* genome either through *Agrobacterium* or biolistics are performed as described elsewhere (Cheng et al., *Plant Physiol*, 115:971-980, 1997; Rasco-Gaunt et al., *J Exp Botany*, 52:865-874, 2000). Transformed cells are placed on selection and regeneration media, and transgenic calli or plantlets are produced. To assess TALE nuclease activity, genomic DNA from transgenic calli or plantlets is extracted using a hexadecyltrimethylammonium bromide- (CTAB-) based method and used as a template for PCR using primers designed to amplify the TALE nuclease target sequence. The resulting amplicons are assessed for NHEJ mutations by next-generation sequencing (e.g., 454 pyrosequencing) or other methods for detecting relatively small indels (e.g., T7 endonuclease direct sequencing).

TALE nuclease activity also is assessed by transiently expressing TALE nuclease pairs in protoplasts. Methods for protoplast preparation and transformation are performed as described elsewhere (He et al., *Plant Cell Reports*, 14:192-196, 1994), with slight modifications. Briefly, leaves from 1 to 2 week old in vitro grown seedlings were used to prepare protoplasts. Seedlings (about 40) were cut above the roots and the leaves were sliced into small (~1-2 mm) sections. Sections were transferred to an enzyme solution containing macerozyme (0.75%) and cellulose (1.50%). The enzyme-plant mixture was incubated at 25° C. for 6-7 hours with shaking at 25 rpm. Following digestion, the solution was passed through a 100 micron filter and the protoplasts were pelleted by centrifugation at 100 g for 5 minutes. Cells were resuspended in W5 (154 mM sodium chloride, 125 mM calcium chloride, 5 mM potassium chloride, 2 mM MES, pH 5.7). The protoplast-W5 solution was then transferred to a tube containing 0.55 M sucrose. The solution was spun at 1000 g for 5 minutes. Protoplasts above the sucrose cushion were removed and transferred to a tube containing W5. Cells were counted, pelleted, and resuspended in MMG (0.4 M mannitol, 15 mM magnesium chloride, 4 mM MES, pH 5.7) to a concentration of 1,000,000 cells per mL. Cells were transformed using polyethylene glycol. DNA encoding TaSBEIIa TALE nuclease monomers was added to the transformation solution. 15 micrograms of each plasmid (30 micrograms total) was added to each reaction. Following transformation, cells were incubated at 25° C. for 48 hours. After incubation, cells were pelleted and DNA was isolated. This DNA was used as a template for PCR amplification using primers oNJB015 (GAGAGATAGCTGGATTAGGC-GATCG, SEQ ID NO:9) and oNJB016 (TTCAGTGGCC-CAAGAGCCAGC, SEQ ID NO:10) for amplifying the SBEIIa_T03 target site, or primers oNJB017 (TCAGATG-GATGTGCATTCTAGCAAG, SEQ ID NO:11) and oNJB018 (TCCCAGCATATTCTCAGACCA, SEQ ID NO:12) for amplifying the SBEIIa_T01 and T02 target sites.

To assess mutations introduced by the TaSBEIIa TALE nuclease pairs, PCR amplicons were deep sequenced using 454 pyrosequencing. Surprisingly, we observed that all TALE nuclease pairs created mutations within all three homoeoalleles, despite differences in target sequences. Specifically, the mutation frequency for TALE nuclease pair TaSBEIIa_T01 was 10.3% at the TaSBEIIa-A target, 6.21% at the TaSBEIIa-B target, and 11.87% at the TaSBEIIa-D target. The mutation frequency for TALE nuclease pair TaSBEIIa_T02 was 13.89% at the TaSBEIIa-A target, 4.93% at the TaSBEIIa-B target, and 5.03% at the TaSBEIIa-D target. The mutation frequency for TALE nuclease pair TaSBEIIa_T03 was 17.73% at the TaSBEIIa-A target, 20.57% at the TaSBEIIa-B target, and 34.58% at the TaSBEIIa-D target.

Mutations introduced by TALE nuclease pair TaSBEIIa_T01 within the SBEIIa-A allele are shown in SEQ ID NOS:13-515.

Mutations introduced by TALE nuclease pair TaSBEIIa_T01 within the SBEIIa-B allele are shown in SEQ ID NOS:516-695.

Mutations introduced by TALE nuclease pair TaSBEIIa_T01 within the SBEIIa-D allele are shown in SEQ ID NOS:696-955.

Mutations introduced by TALE nuclease pair TaSBEIIa_T02 within the SBEIIa-A allele are shown in SEQ ID NOS:956-1522.

Mutations introduced by TALE nuclease pair TaSBEIIa_T02 within the SBEIIa-B allele are shown in SEQ ID NOS:1523-1629.

Mutations introduced by TALE nuclease pair TaSBEIIa_T02 within the SBEIIa-D allele are shown in SEQ ID NOS:1630-1711.

Mutations introduced by TALE nuclease pair TaSBEIIa_T03 within the SBEIIa-A allele are shown in SEQ ID NOS:1712-2185.

Mutations introduced by TALE nuclease pair TaSBEIIa_T03 within the SBEIIa-B allele are shown in SEQ ID NOS:2186-3207.

Mutations introduced by TALE nuclease pair TaSBEIIa_T03 within the SBEIIa-D allele are shown in SEQ ID NOS:3208-5080.

To ensure reproducibility, the protoplast experiment was repeated and amplicons encompassing the TALE nuclease target sites were deep sequenced.

Mutations introduced by TALE nuclease pair TaSBEIIa_T01 within the SBEIIa-A or SBEIIa-B or SBEIIa-D alleles are shown in SEQ ID NOS:5083-7268. Mutations introduced by TALE nuclease pair TaSBEIIa_T02 within the SBEIIa-A or SBEIIa-B or SBEIIa-D alleles are shown in SEQ ID NOS:7269-8763. Mutations introduced by TALE nuclease pair TaSBEIIa_T03 within the SBEIIa-A or SBEIIa-B or SBEIIa-D alleles are shown in SEQ ID NOS: 8764-11889.

The majority of TALE nuclease-induced SBEIIa mutations in wheat cells included a deletion of the nucleotide at position 8 or position 9 of the 15 nucleotide TALE nuclease spacers. Specifically, TALE nuclease pair SBEIIa_T01 introduced mutations into the SBEIIa-A allele that comprised a deletion of the adenine nucleotide at position 1097 of SEQ ID NO:1. TALE nuclease pair SBEIIa_T01 introduced mutations into the SBEIIa-B allele that comprised a deletion of the adenine nucleotide at position 1376 of SEQ ID NO:5081. TALE nuclease pair SBEIIa_T01 introduced mutations into the SBEIIa-D allele that comprised a deletion of the adenine nucleotide at position 1370 of SEQ ID NO:5082. TALE nuclease pair SBEIIa_T02 introduced mutations into the SBEIIa-A allele that comprised a deletion of the guanine nucleotide at position 977 of SEQ ID NO:1. TALE nuclease pair SBEIIa_T02 introduced mutations into the SBEIIa-B allele that comprised a deletion of the guanine nucleotide at position 1256 of SEQ ID NO:5081. TALE nuclease pair SBEIIa_T02 introduced mutations into the SBEIIa-D allele that comprised a deletion of the guanine nucleotide at position 1250 of SEQ ID NO:5082. TALE nuclease pair SBEIIa_T03 introduced mutations into the SBEIIa-A allele that comprised a deletion of the guanine nucleotide at position 539 of SEQ ID NO:1. TALE nuclease pair SBEIIa_T03 introduced mutations into the SBEIIa-B allele that comprised a deletion of the guanine nucleotide at position 813 of SEQ ID NO:5081. TALE nuclease pair SBEIIa_T03 introduced mutations into the SBEIIa-D allele that comprised a deletion of the guanine nucleotide at position 811 of SEQ ID NO:5082.

Example 3—Regeneration of *T. aestivum* Lines with TALE Nuclease-Induced SBEIIa Mutations

*T. aestivum* lines were created with mutations in one or more SBEIIa alleles. Plant parts from *T. aestivum* (e.g., immature scutella, immature embryos, or embryogenic callus) were bombarded with one or more plasmids encoding TALE nuclease pairs and a plant stable marker. Alternatively, plant parts are transformed via *Agrobacterium* with one or more T-DNAs encoding TALE nuclease pairs and a plant selectable marker. Following transformation, plant parts were placed on selection and regeneration media. Materials and methods for regeneration were used as described elsewhere (Sparks et al., *Humana Press,* 478:71-92, 2009). The plasmid and T-DNA contained a selectable marker (e.g., bialaphos) for conferring herbicide tolerance and to facilitate selection of transgenic plants. Transformation efficiencies were monitored using a control plasmid or T-DNA plasmid containing pNos:YFP and pNos:Bar or pNos:PMI. To visualize cells or plants that have stably integrated this DNA into their genome, a fluorescent stereomicroscope was used to enable visualization of YFP expressed in cells transformed with pNos:YFP.

Thirty-four experiments (TABLE 1) were carried out using biolistics as the DNA delivery method. Wheat scutella were isolated from immature kernels and used for transformation and regeneration of complete transgenic plants. More than 3,600 scutella were isolated and transformed with plasmids encoding SBEIIa_T03 TALE nucleases (pCLS27224, pCLS27225).

T0 whole plants regenerated on selection were transferred to soil. After about a 1-week acclimation period, DNA was isolated from leaves and screened for the presence of integrated plasmid DNA. Twenty transgenic plants were identified, resulting in a transformation efficiency of 0.55%.

The twenty transgenic plants were then advanced to genotypic screening for mutations at the SBEIIa_T03 target site by PCR, cloning, and Sanger sequencing. Primers specific for each SBEIIa gene were used to amplify the SBEIIa_T03 target sites. Primers that were used to amplify the SBEIIa_T03 target site in the A genome were oJG029 (CGGACTGCTGCCGCGAT; SEQ ID NO:11902) and oJG030 (TGTAGCCATCAATTATACATCTACG; SEQ ID NO:11903). Primers that were used to amplify the SBEIIa_T03 target site in the B genome were oJG031 (GGCGGACTGCTGCGATC; SEQ ID NO:11904) and oJG032 (CAATTGTAGCCAGCAATTATACATA; SEQ ID NO:11905). Primers that were used to amplify the SBEIIa_T03 target site in the D genome were SBEIIa-D-L1 (TTTTCCCCGCGGGGAAATGCG; SEQ ID NO:11906) and oNJB033 (TCCACCTTCATGTTGGTCAATAGCAGC; SEQ ID NO:11907). The resulting amplicons were cloned and sequenced.

Four T0 plants were identified with mutations in one, two, or all three SBEIIa genes. These T0 plants are referred to as Ta125-2, Ta128-1, Ta137-1, and Ta139-1.

Ta125-2 contained mutations in the SBEIIa-A, SBEIIb-B, and SBEIIa-D genes (FIG. 4). The mutations identified in the SBEIIa-A gene were a 2 bp insertion (SEQ ID NO:11909) and a 23 bp deletion (SEQ ID NO:11910). The mutations identified in the SBEIIa-B gene were a 4 bp deletion (SEQ ID NO:11912) and a 20 bp deletion (SEQ ID NO:11913). The mutations identified in the SBEIIa-D gene were a 4 bp deletion (SEQ ID NO:11915) and a 12 bp deletion (SEQ ID NO:11916).

Ta128-1 contained mutations in the SBEIIb-B and SBEIIa-D genes (FIG. 5). The mutations identified in the SBEIIa-B gene were a 1 bp insertion (SEQ ID NO:11917) and a 1 bp deletion (SEQ ID NO:11918). The mutations identified in the SBEIIa-D gene were a 21 bp deletion (SEQ ID NO:11919) and an 890 bp deletion (SEQ ID NO:11920).

Ta137-1 contained mutations in the SBEIIa-A, SBEIIb-B, and SBEIIa-D genes (FIGS. 6A and 6B). The mutations identified in the SBEIIa-A gene were a 4 bp deletion (SEQ ID NO:11921), a 7 bp deletion (SEQ ID NO:11922), a 13 bp deletion (SEQ ID NO:11923), and a 167 bp deletion (SEQ ID NO:11924). The mutation identified in the SBEIIa-B gene was a 17 bp deletion (SEQ ID NO:11925). The mutations identified in the SBEIIa-D gene were a 6 bp deletion (SEQ ID NO:11926), a 10 bp deletion (SEQ ID NO:11927), a 13 bp deletion (SEQ ID NO:11928), a 14 bp deletion (SEQ ID NO:11929), and a 15 bp deletion (SEQ ID NO:11930).

Ta139-1 contained mutations in the SBEIIa-A, SBEIIb-B, and SBEIIa-D genes (FIG. 7). The mutation identified in the SBEIIa-A gene was a 4 bp deletion (SEQ ID NO:11931). The mutations identified in the SBEIIa-B gene were a 4 bp deletion (SEQ ID NO:11932), a 10 bp deletion (SEQ ID NO:11933), and a 22 bp deletion (SEQ ID NO:11934). The mutations identified in the SBEIIa-D gene were an 11 bp deletion (SEQ ID NO:11935) and a 17 bp deletion (SEQ ID NO:11936).

To generate wheat lines that stably transmitted mutations to progeny, the line Ta125-2 was selfed and the progeny were screened for homozygous mutations. After selfing line Ta125-2 once, a mutant was generated with the genotype -23/-23, -4/-4, -12/-12, corresponding to the SBEIIa-A, SBEIIa-B, SBEIIa-D alleles, respectively. The resulting plant was named Ta125-2-14, and contained the mutations shown in SEQ ID NOs:11910, 11912 and 11916 (FIG. 8).

After selfing line Ta125-2 three times, two mutants were generated with homozygous mutations that were predicted to result in frameshifts. The first line, which is named Ta125-2-44-1-1a (-23/-23, -4/-4, -4/-4), has a genotype of -23/-23, -4/-4, -4/-4, corresponding to the SBEIIa-A, SBEIIa-B, SBEIIa-D alleles, respectively. The resulting plant [Ta125-2-44-1-1a (-23/-23, -4/-4, -4/-4)] contained the mutations shown in SEQ ID NOs:11910, 11912, and 11915 (FIG. 9). The second line, which is named Ta125-2-44-1-2a (-23/-23, -20/-20, -4/-4), has a genotype of -23/-23, -20/-20-4/-4, corresponding to the SBEIIa-A, SBEIIa-B, SBEIIa-D alleles, respectively. The resulting plant [Ta125-2-44-1-2a (-23/-23, -20/-20, -4/-4)] contained the mutations shown in SEQ ID NOs: 11910, 11913 and 11915 (FIG. 10).

Multiplex PCR was performed to detect integration of DNA from the vectors used for transformation. The PCR failed to amplify sequence from the transformed vectors in six lines that are the progeny of Ta125-2-44 (which includes Ta125-2-44-1-1a and Ta125-2-44-1-2a), thereby indicating that the transgene had segregated away.

Example 4—Assessing Phenotypes in Modified *T. aestivum* Plants

*T. aestivum* plants containing mutations within SBEIIa alleles were assessed for total protein and starch content, percent of amylose and amylopectin in total starch, and total resistant starch and dietary fiber. Composition analysis was performed in plants grown in greenhouse conditions and field conditions.

Protein content was determined following Official Methods AACC 46-30 and AOAC 992.15 (Official Methods of Analysis of AOAC INTERNATIONAL (2005) 18th Ed., AOAC International, Gaithersburg, MD). Total starch and resistant starch were calculated following Official Method AOAC 2002.02 (Official Methods of Analysis of AOAC INTERNATIONAL, supra). To determine the amylose/amylopectin ratio, the Amylose Kit (K-AMYL) from Megazyme (Bray, County Wicklow, Ireland) was used. As an alternative method for analyzing amylose content, iodine binding and/or the concanavalin A method are performed as described elsewhere (Zhu et al., *Cereal Chem*, 85:51-58, 2008; and Gibson et al., *J. Cereal Sci*, 25:111-119, 1997). Total dietary fiber was calculated following Official Methods AOAC 2009.01 and 2011.25 (Official Methods of Analysis of AOAC INTERNATIONAL, supra).

Three to four biological repetitions and one to three technical repetitions were used to determine the content of protein, starch, amylose, amylopectin, resistant starch, and dietary fiber in white flour extracted from the following groups: (1) Ta125-2-44-1a (-23/-23, -4/-4, -4/-4), (2) Ta125-2-44-2a (-23/-23, -20/-20, -4/-4), (3) Ta125-2-14 (-23/-23, -4/-4, -12/-12), and (4) wild type control.

Results obtained from plants grown in greenhouse conditions showed a significant increase in total protein in the complete knockout and partial knockout lines, compared to wild type controls, whereas total starch was significantly reduced. Amylose content was higher in the complete knockout lines than in wild type control—from 26.5% to 49.9% and 50.3%, respectively in Ta125-2-44-1-1a (-23/-23,-4/-4,-4/-4) and Ta125-2-44-1-2a (-23/-23,-20/-20,-4/-4). The partial knockout showed an amylose content similar to WT (TABLE 1). Similar results were obtained from plants grown in field conditions, with complete knockout and partial knockout lines showing higher protein, lower starch, and complete knockout lines showing higher amylose content (TABLE 2).

Resistant starch and total dietary fiber levels were found to be significantly higher in the complete knockout samples, but not in the partial knockout samples. Complete knockout lines grown in greenhouse conditions showed a 7- to 8-fold increase in resistant starch in white flour as compared to wild type control—from 2.2% to 25.9% and 28.8%, respectively in Ta125-2-44-1-1a (-23/-23,-4/-4,-4/-4) and Ta125-2-44-1-2a (-23/-23, -20/-20,-4/-4) (TABLE 3). Total dietary fiber in white flour was significantly increased in the complete knockout lines compared to the wild type control, both in plants grown in greenhouse and in plants grown in field conditions. Complete knockout lines grown in the field showed up to a 6.2-fold increase in total dietary fiber content (TABLES 3 and 4). Dietary fiber was quantified in whole wheat flour samples from plants grown in greenhouse conditions, showing a 2-fold increase compared to the wild type control—from 18% in the wild type control to 34.65% and 32.74% in Ta125-2-44-1-1a (-23/-23, -4/-4,-4/-4) and Ta125-2-44-1-2a (-23/-23,-20/-20,-4/-4), respectively (TABLE 5).

Example 5—Assessing Morphology in Complete Knockout *T. aestivum* Plants

*T. aestivum* plants containing complete knockout mutations within SBEIIa alleles were assessed for morphological characteristics. One to three measurements were taken for three independent plants to quantify the number of seeds per spike, and to determine plant height. Germination tests were performed as described in the "AOSA Rules for Testing Seeds: Volume 1. Principles and Procedures," pp. 6-63, 2017. Four independent repetitions with 400 seeds each were done for each of the complete knockout mutants and wild type controls.

Figure 11A:
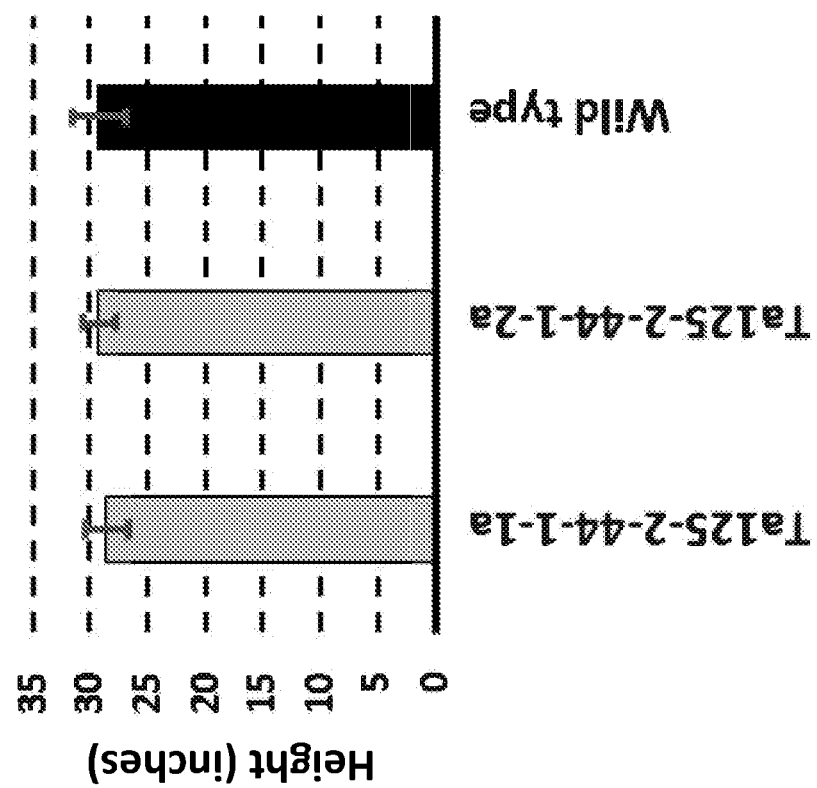

Plant height and number of seeds per spike were comparable in the mutant lines and the wild type controls (FIGS. 11A and 11B). Germination was significantly lower in the Ta125-2-44-1-2a line (94.5%) compared to the wild type control (98%) at both the P=0.05 and P=0.01 levels, while mutant line Ta125-2-44-1-1a demonstrated germination efficiency that was comparable to that of the wild type control (FIG. 11C).

TABLE 1

Composition analysis (protein %, starch %, and amylose % and amylopectin % of total starch) in white flour samples grown in greenhouse conditions. Data are expressed on a dry basis.

| Sample | Total Protein (%) | Standard Deviation (%) | Total Starch (%) | Standard Deviation (%) | Amylose (% of Total Starch) | Standard Deviation (%) | Amylopectin (% of Total Starch) | Standard Deviation (%) |
|---|---|---|---|---|---|---|---|---|
| Ta125-2-44-1-1a (−23/−23,−4/−4,−4/−4) | 21.2 | 0.9 | 58.1 | 1.4 | 50.3 | 1.4 | 49.7 | 1.4 |
| Ta125-2-44-1-2a (−23/−23,−20/−20,−4/−4) | 21.9 | 0.4 | 56.9 | 0.5 | 49.9 | 2.7 | 50.1 | 2.7 |

TABLE 1-continued

Composition analysis (protein %, starch %, and amylose % and amylopectin % of total starch) in white flour samples grown in greenhouse conditions. Data are expressed on a dry basis.

| Sample | Total Protein (%) | Standard Deviation (%) | Total Starch (%) | Standard Deviation (%) | Amylose (% of Total Starch) | Standard Deviation (%) | Amylopectin (% of Total Starch) | Standard Deviation (%) |
|---|---|---|---|---|---|---|---|---|
| Ta125-2-14 (−23/−23,−4/−4,−12/−12) | 22.5 | N/A | 60.0 | N/A | 24.3 | N/A | 75.7 | N/A |
| Wild type control | 18.7 | 1.9 | 63.0 | 1.1 | 26.5 | 0.4 | 73.5 | 0.4 |

TABLE 2

Composition analysis (protein %, starch %, and amylose % and amylopectin % of total starch) in white flour samples grown in field conditions. Data expressed in a dry basis.

| Sample | Total Protein (%) | Standard Deviation (%) | Total Starch (%) | Standard Deviation (%) | Amylose (% of Total Starch) | Standard Deviation (%) | Amylopectin (% of Total Starch) | Standard Deviation (%) |
|---|---|---|---|---|---|---|---|---|
| Ta125-2-44-1-1a (−23/−23,−4/−4,−4/−4) | 19.1% | 0.1% | 61.7% | N/A | 47.7% | 0.5% | 52.3% | 0.5% |
| Ta125-2-44-1-2a (−23/−23,−20/−20,−4/−4) | 18.4% | 0.3% | 61.7% | 0.3% | 49.9% | 2.6% | 50.1% | 2.6% |
| Ta125-2-14 (−23/−23,−4/−4,−12/−12) | N/A | N/A | N/A | N/A | N/A | N/A | N/A | N/A |
| Wild type control | 16.3% | 0.2% | 67.9% | 0.7% | 25.4% | 1.2% | 74.6% | 1.2% |

TABLE 3

Composition analysis (resistant starch % and total dietary fiber %) in white flour samples grown in greenhouse conditions. Data expressed in a dry basis.

| Sample | Resistant Starch (%) | Standard Deviation (%) | Fold increase | Total Dietary Fiber (%) | Standard Deviation (%) | Fold increase |
|---|---|---|---|---|---|---|
| Ta125-2-44-1-1a (−23/−23,−4/−4,−4/−4) | 17.8 | 3.3 | 7.9 | 16.9 | 0.8 | 2.6 |
| Ta125-2-44-1-2a (−23/−23,−20/−20,−4/−4) | 15.5 | 0.7 | 6.9 | 15.7 | 1.1 | 2.5 |
| Ta125-2-14 (−23/−23,−4/−4,−12/−12) | 2.2 | N/A | 1.0 | 5.4 | N/A | 0.9 |
| Wild type control | 2.2 | 0.0 | 1.0 | 6.4 | 0.3 | 1.0 |

TABLE 4

Total dietary fiber (%) in white flour samples grown in field conditions. Data expressed in a dry basis.

| Sample | Total Dietary Fiber (%) | Standard Deviation (%) | Fold increase |
|---|---|---|---|
| Ta125-2-44-1-1a (−23/−23,−4/−4,−4/−4) | 28.8% | N/A | 6.2 |
| Ta125-2-44-1-2a (−23/−23,−20/−20,−4/−4) | 25.9% | 1.8% | 5.6 |
| Ta125-2-14 (−23/−23,−4/−4,−12/−12) | N/A | N/A | N/A |
| Wild type control | 4.7% | 0.2% | N/A |

TABLE 5

Total dietary fiber (%) in whole flour samples grown in greenhouse conditions. Data expressed in a dry basis.

| Sample | Total Dietary Fiber (%) | Standard Deviation (%) | Fold increase |
|---|---|---|---|
| Ta125-2-44-1-1a (−23/−23,−4/−4,−4/−4) | 34.65 | 0.05 | 1.92 |
| Ta125-2-44-1-2a (−23/−23,−20/−20,−4/−4) | 32.74 | 2.20 | 1.82 |
| Wild type control | 18.02 | 0.90 | N/A |

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

wild-type, wherein the plant, plant part, or plant cell contains an A, B, and D genome and the mutations are homozygous mutations in the SBEIIa-A, B and D alleles.

SEQUENCE LISTING (11937 sequences)

SEQ ID NO: 1 - DNA, 9893 bp, Triticum aestivum
  Genomic sequence of SBEIIa, A genome from Triticum aestivum cv Chinese Spring
atggcgacgtttgcggtgtccggcgcgaccctcggtgtggcgcggcccgccggcgccggcggcggactgctgccgcgatccggctcggagcggaggggcggggtggacctgccgtcgctgctcctcaggaagaaggactcctctcgtacgcctcgctcgctcgctccaatctccccgtccatttttgccccccttctctctccctatctgcgcgcgcatggcctgttcgatgctgttccccagttgatctccatcaacgagagagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaaaactcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctgggacgtagatgtataattgatggctacaatttgctcataattacgatacaaataactgtctctgatcattgcaattacagagtggcaaactgattaaaatgtgatagatgggttatagattttactttgctaattcctctaccaaattcctggggaaaaaaatctaccagttgggcaacttagtttcttatctttgttgcctctttgttttggggaaaacacactgctaaatttgaatgattttgggtatgcctccgtggattcaacagatacagcgaatacaggagaattcgtgctgctattgaccaacatgaaggtggattggaagcattttctcgtggttatgaaaagcttggatttacccgcaggtaaatttaaagcttcagtattatgaagcgcctccactagtctacttgcatatcttacaagaaaatttataattcctgttttcgcctctcttttttccagtgctgaaggtattgtctagttgcatatcttataagaaaatttatgttcctgttttcccctattttccagtgctgaaggtatcacttaccgagaatgggctcctggagcgcatgtacgtcttttaagtcttaacagacaccttccaattcattgttaatggtcacactattcaccaactagcttactggacttacaacttagcttactgaatactgaccagttgctctaaatttatgatctggcttttgcatcctattacagtctgcagcattagtaggtgacttcaacaattggaatccgaatgcagatactatgaccagagtatgtctacagcttggcaatcttccacctttgcttcataactactgatacatctatttgtatttattttgctgtttgcacattccttaaagttgagcctcaactatatcatatcaaaatggtataatttgtcagtgtcttaagcttcagcctaaagattctactgaaattggtccatctttttgagattgaaaatgagtatattaaggatggatgaataggtgcaacactcccattctttggtagaaccttctgcattatgtgtgttttttcatctacaatgagcatatttccatgctatcagtgaaggtttgctcctattgatgccgatatttgatatgatcttttcaggatgattatggtgtttgggagattttcctccctaacaatgctgatggatccccagctattcctcatggctcacgtgtaaaggtaagctggccaattatttagttgagcatgtagcattttcgaactctgcccactaagggtccctttgcctttctgttttctagatacggatggatactccatctggtgtgaaggattcaatttctgcttggatcaagttctctgtgcaggctccaggtgaaataccattcaatggcatatattatgatccacctgaagaggtaagtatcgatctccattacattattaaatgaaatttccagtgttacggttttttaatacccatttcgtgtctcactgacatgtgagtcaagacaatactttagaatttggaagtgacatatgcattaattcaccttctaagggctaaggggcaagcaaccatggtgatgtttgtatgcttgtgtgtgacttaagatcttatagctcttttatgtgttctctgttggttaggatattccattttgaccttttgtgaccatttactaaggatattttacatgcaaatgcaggagaagtatgtcttccaacatcctcaacctaaacgaccagagtcactgaggatttatgaatcacacattggaatgagcagcccagtatgtcaataagttatttcacctgtttctggtctgatggtctattctatggattttttagttctgttatgtattgttaacatataacatggtgcattcacgtgacaacctcgattttattttctaatgttattgcaatagctcggtataatgtaaccatgttactagcttaagatggttagggtttcccacttaggatgtatgaaatatcgcattggagcatctccagcaagccatttttttgacggttaacagcaggagctctgcttttcattataggagagggaaatgctgtacagactgaagtcagtcagagcaaagtaacttagaatcatttatgggccaccctgcacagggcagaaggcaggcaggaacgatcctctacagccgtcggattgcctccatcagaggaatcctggccgttaatcatgctctggcccagtggtcagaatgcatcaaccagactgaggtgctcgcctccttattggtaaaggatgcagcggtacgagcctattgaacagatcctgttcaagtaaggccgttctccagcaagccatttcctagcttattaatgagagagagagagggggggggtctgtattctgcgagcaattcaaaaacttccattgttctgaggtgtacgcattgtagggatctcccattatgaagaggatatagttaattctttgtaacctacttggaaacttgagtcttgcggcatcgctaatatattctatcatcacaatacttagaggatgcatctgaatattttagtgggatcttgcacaggaaccgaagataaattcatatgctaattttagggatgaggtgctgccaagaattaaaaggcttggatacaatgcagtgcagataatggcaatccaggagcattcatactatgcgagctttgggtattcacacaatccatttttttctgttcttttttctgtatgcgcctcttcacccatttggagctattacatcctaatgcttcgtgcacatagaatatttggatataattctttagtagacatatagtacaacaacagttggtatttctgacttgtatgaccattttattgttgttggcttgttccaggtaccatgttactaatttttttgcaccaagtagccgttttggaactccagaggacttaaaatccctgatcgatagagcacatgagcttggtttgcttgttcttatggatattgttcataggtaagtagtccaattaattttagctgctttactgtttatctggtattctaaatggcagggccgtatcgacgagtatttttccattctatataattgtgctacatgacttcttttttctcagatgtattaaaccagttggacatcaaatgtatttggtacatctagtaaactgacagtttcaaaagaacatcgttttgtaatggcaacatgatttgatgccatagatgtggactgagaagttcagatgctatcaagaaaattaatcaactggccatgtactcgtggcactacatagagtttgcaagttggaaaactgacagcaatacctcactgataagtagctaggccccacttgccagcttcatattagatgttacttccctgttgaactcatttgaacatattacttaaagttcttcatttgtcctaagtcaaacttctttaagtttgaccaagtctactgaaaaatatatcaacatctacaacaccaaattggtttcattagattcacaatttttattttgttatattagcacacctttgatgttgtagatatcagcacatttttctacagacttggtcaaatatagagaagtttgacttaggacaaatctagaacttcaatcaatttggatcagaggggatagtccatactggttgattatattcggtaacatcaaataatatagatagatgtcaacactttaacaaaaaaatcagaccttgtcaccaaatatgtatcagaccatctgtttgctttagccacttgttttcatatttatgtgtttgtacctaatctatttttacttctacttggtttggttgattttttttcagttgcattgcttcatcaatgattttgtgtaccctgcagtcattcatcaaataatacccttgacggcttgaatggtttcgatggcactgatacacattacttccacggtggtccacgtggccatcattggatgtgggattctcgtctattcaactatgggagttgggaagtatgtagctctgacttctgtcaccatatttggctaactgttcctgttaaatctgttcttacacatgtcgatattctattcttatgtaggtattgagattcttactgtcaaacgcgagatggtggcttgaagaatataagtttgatggatttcgatttgatggggtgacctccatgatgtatactcaccatggattacaagtaagtcatcaagtggtttcagtaacttttttagggcactgaaataattgctatgcatcataacatgtatcatgatcaggacttgtgctacggagtcttagatagttccctagtacgcttgtacaattttacctgatgagatcatggacgattcgaagtgattattatttatttttcttctaagtttgcttcttgttctagatgacatttactgggaactatggcgagtattttggatttgctactgatgttgacgcggtagtttacttgatgctggtcaacgatctaattcatggactttatcctgatgctgtatccattggtgaagatgtaagtgcttacagtatttatgatttttaaccagttaagtagttttattttgggatcaggctgttactctttttgttaggggtaagatctctcttttcataacaatgctaatttataccttgtatgataatgcatcacttaggtaatttgaaaagtgcaaggccattcaagcttacgagcatattttttgatggctgtaatttatttgatagtatgcttgtttgggtttttcagtaaatgggagtgtgtgactaatgttgtattagaaatgggcaaccttgtcaattgcttcagaaggctaacttagattccgtaaacgcttcagaaatgagaggctattcccatggacatgaaattatacttcagtgtgttctgtacatgtatttgtaagagcaagagcaacatggtttaacttaaattcctgcactgctatggaatctcactgtatgttgttagtgtaacatccgcaaacaagtaatcctgagctttcaactcatgagaaaatatgaggttccacttctgccagcattaactgttcacagttctaatttgtgtaactgtgaaattgttcaggtcagtggaatgcccacattttgcatccctgttccagatggtggtgttggttttgactatcgcttgcatatggctgtagcagataaatggattgaactcctcaagtaagtgcaggaatattggtgattacatgcgcacaatgatctagattacaatttctaaatggtaaaaggaaaatatgtatgtgaatatctagacattttcctgttatcagcttgtatacgagaagtcatacatggtttaaatagcaaatctcagaaatgtaatggctagtgtctttatgctggacattgtacattgcgctgtagcaggccagtcaacacagttagcaatattttcagaaacaataattatttatatccgtatatggggaaagtaggtatataaactgtggtcattaattgtgttcaccttttgtcctgtataagcatgggcagtaggtaataaatttagccagataaaataaatcgttattaggtttacaaaaggaatatacagggtcatgtagcatatctagttgtaattattgaaaaggctgacaaaaggctcggtaaaaaaaatccagatacgcaggaacgcgactaaagctcaaatatttatagtggtctctgttgcttgctgtatatttgtatctgcacatatatgaaattactactacacagctgccaatctgtcatgatctgtgttctgctttgtgctatttaaattttaattcgatacattggcaataataaacttaactattcaaccaatttggtggataccagagatttctgccctcttttcgtaatgttgtgctcctgctgctgttctctgctgttacaaaagctgttctcagtttttttacatcattatttttgtgtgtgagtacttttagcatgtttttcgaagctgtgagttgttggtacttaatacattcttggtagtgtccaaatatgctgcagtctaatttagcatttctttaacacaggcaaagtgacgaatcttggaaaatgggtgatattgtgcacaccctaacaaatagaaggtggcttgagaagtgtgtaacttatgcagaaagtcatgatcaagcactagttggtgacaagactattgcattctggttgatggataaggtactagctgttacttttggaccaaaagaattacacaattgatttgtctcatcagattgctagtgttttcttgtgataaagattggctgcgtcacccatcaccagctatttcccaactgttacttgagcaaaatttgctgaaaacgtaccatgtggtactgtggcggcttgtgaactttgactgttatggtgcaaatttctgttcttatttttttgattgcttatgttaccgttcatttgctcatccctttcagagaccagccaaagtcacgtgtagctgtgtgatctattatctgaatcttgagcaaattttattaatagggtaaaacccaacgaattatttgcttgaattttaatatacagacgtatagtcacctggtgctttcttaaatgattaccatagtgcctgaaggctgaaatagttttggcgtttcttggacgccgcctaaaggagtgattttgggtagattcctggtcgagccctcgttacaacatacattttggagatatgcttagtaactgctctgggaagtttggtcagaagtctgcatctacacgctccttgaggttttattatgacgccatctttgtaactagtggcagctgtaaggaaacacattcaaaaggaaacggtcacattattctagtcaggaccaccacactaagaggaatattctgttccaattttatgagtttttgggactccaaagggaacaaaagtgtctcatattgtgcttataactacagttgtttttataccagtgtagttccattccaggacagttgatacttggtactgtgctgtaaattattgatctggcatagaacagcatgaacatatcaagctctctttgtgcaggatatgtatgatttcatggctctggataggccttcaactcctcgcattgatcgtggcatagcattacataaaatgatcaggcttgtcaccatgggtttaggtggtgaaggctatcttaacttcatgggaaatgagtttgggcatcctggtcagtctttacaactttaattgcattctgcatagttgtgatttactgtaatttgaaccatgctttgttttcacattgtatgtattatgtaatctgttgcttccaaggaggaagttaacttctatttacttggcagaatggatagattttccaagaggtccgcaaactcttccaaccggcaaagttctccctggaaataacaatagttatgataaatgccgccgtagatttgatcttgtaagttttagcttagctattacatttcctcactagatctttatcggccatttatttcttgatgaaatcataatgtttgttaggaaagatcaacattgcttttgtagttttgtagacgttaacataaatatgtgttaagagttgttgatcattaagaatatcatgattttttgtagggagatgcagattttcttagatatcgtggtatgcaagagttcgatcaggcaatgcagcatcttgaggaaaaatatggggtatgtcactggtttgtctttgttgcataacaagtcacagtttaacattagtctcttcaaatggtcaaaaaagtgtagaattaatttctgtaatgagatgaaaactgtgcaaaggcgggagctggaattgctcttcaccaattaaaactattttcttgagcgatagtgtattgatacctataccaacactgacaatgtaactgcagtttatgacatctgagcaccagtatgtttcacggaaacacgaggaagataaggtgatcatcttcgaaagaggagatttggtatttgttttcaacttccactggagcaatagcttttttgactaccgtgttgggtgttccaggcctgggaagtacaaggtatgctttgcttttgcattgtccacccttcaccagtagggttagtgggggcttctacaacttttaagtccacatgtatagagtttgttggtcgtgcagctatcaatataaagaatatgataatttgtaaagaaaagaatttgttgctcgagctgttgtagtcatataacatccccgaagcacatctactattcattcatattatctacttaagggtttgttacaatctttgtactcagttggactcactctaatactggaactgtttaccgaatctaccctaatcatcctagcagttttagagcagccccatttggacagtccactgggtttagttggtttgtgacagtttctgctatttcttatcaggtggccttagactccgacgatgcactctttggtggattcagcaggcttgatcatgatgtcgactacttcacaaccgtaagtctgggcccaagcgttacttgactcgtcttgactcaactgcttacaaatctgaatcaacttctcatttgctgatgcccttgcaggaacatccgcatgacaacaggccgcgctctttctcggtgtacactccgagcagaactgcggtcgtgtatgcccttacagagtaa

SEQ ID NO: 2 - protein, 823 aa, Triticum aestivum
  SBEIIa-A amino acid sequence
MATFAVSGATLGVARPAGAGGGLLPRSGSERRGGVDLPSLLLRKKDSSRAVLSRAASPGKVLVPDGESDDLASPAQPEELQIPEDIEEQTAEVNMTGGTAEKLESSEPTQGIVETITDGVTKGVKELVVGEKPRVVPKPGDGQKIYEIDPTLKDFRSHLDYRYSEYRRIRAAIDQHEGGLEAFSRGYEKLGFTRSAEGITYREWAPGAHSAALVGDFNNWNPNADTMTRDDYGVWEIFLPNNADGSPAIPHGSRVKIRMDTPSGVKDSISAWIKFSVQAPGEIPFNGIYYDPPEEEKYVFQHPQPKRPESLRIYESHIGMSSPEPKINSYANFRDEVLPRIKRLGYNAVQIMAIQEHSYYASFGYHVTNFFAPSSRFGTPEDLKSLIDRAHELGLLVLMDIVHSHSSNNTLDGLNGFDGTDTHYFHGGPRGHHWMWDSRLFNYGSWEVLRFLLSNARWWLEEYKFDGFRFDGVTSMMYTHHGLQMTFTGNYGEYFGFATDVDAVVYLMLVNDLIHGLYPDAVSIGEDVSGMPTFCIPVPDGGVGFDYRLHMAVADKWIELLKQSDESWKMGDIVHTLTNRRWLEKCVTYAESHDQALVGDKTIAFWLMDKDMYDFMALDRPSTPRIDRGIALHKMIRLVTMGLGGEGYLNFMGNEFGHPEWIDFPRGPQTLPTGKVLPGNNNSYDKCRRRFDLGDADFLRYRGMQEFDQAMQHLEEKYGFMTSEHQYVSRKHEEDKVIIFERGDLVFVFNFHWSNSFFDYRVGCSRPGKYKVALDSDDALFGGFSRLDHDVDYFTTEHPHDNRPRSFSVYTPSRTAVVYALTE

SEQ ID NO: 3 - protein, 9 aa, Artificial
  Consensus sequence for the dodecapeptide family of homing endonuclease
LAGLIDADG

SEQ ID NO: 4 - DNA, 20 bp, Artificial
  Primer for amplifying SBEIIa sequence
actcctctcgtacgcctcgc

SEQ ID NO: 5 - DNA, 23 bp, Artificial
  Primer for amplifying SBEIIa sequence
ccaatccaccttcatgttggtca

SEQ ID NO: 6 - DNA, 50 bp, Triticum aestivum
  Binding site for TALEN pair TaSBEIIa_T02
ttcagaaccgactcagggcattgtggaaacaatcactgatggtgtaacca

SEQ ID NO: 7 - DNA, 49 bp, Triticum aestivum
  Binding site for TALEN pair TaSBEIIa_T01
tatacgagattgacccaacgctgaaagattttcggagccatcttgacta

SEQ ID NO: 8 - DNA, 49 bp, Triticum aestivum
  Binding site for TALEN pair TaSBEIIa_T03
tcctgagccgcgcggcctctccagggaaggtcctggtgcctgacggcga

SEQ ID NO: 9 - DNA, 25 bp, Artificial
  Primer for amplifying SBEIIa sequence
gagagatagctggattaggcgatcg

SEQ ID NO: 10 - DNA, 21 bp, Artificial
  Primer for amplifying SBEIIa sequence
ttcagtggcccaagagccagc

SEQ ID NO: 11 - DNA, 25 bp, Artificial
  Primer for amplifying SBEIIa sequence
tcagatggatgtgcattctagcaag

SEQ ID NO: 12 - DNA, 21 bp, Artificial
  Primer for amplifying SBEIIa sequence
tcccagcatattctcagacca

SEQ ID NO: 13 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctttcggagccatcttgactaccggtaatgcctacccgctactttcgctcattttgaattaaggtcctttcgtcatgcaaatttggggaacatcaaagaatcaaagactagggaccacattttcttacagttcccctcatggtctgagaatatgctggga

SEQ ID NO: 14 - DNA, 459 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 15 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 16 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaaccaggagatggggcagaaaaatatacgagattgacccaacacttttcggagccatcttgactacccggtaatgcctacccgctgctttcgctcattttgaattaaggtcctttcatcatgcaaatttggggaacatcaaagagacaaagactagggaccaccatttcatacagatcccctcgtggtcctgagaatatgct

SEQ ID NO: 17 - DNA, 429 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattcggagccatcttgactaccggtaatgcctaccgctactttcgctcattttgaattaaggtcctttcgtcatgcaaatttggggaacatcaaagagacaaagactagggaccaacttttcttacagttcccctc

SEQ ID NO: 18 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatat

SEQ ID NO: 19 - DNA, 459 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaaccaggagatgggcagaaaaatatacgagattgacccaacgagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 20 - DNA, 470 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 21 - DNA, 468 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagacttagggaccactattttcttacagttcccctcatggtctgagaatatgctggga

SEQ ID NO: 22 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacagtgacagggggaactgcagaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 23 - DNA, 468 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 24 - DNA, 432 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattcggagccatcttgactaccggtaatgcctacccgctactttcgctcattttgaattaaggtcctttcgtcatgcaaatttggggaacatcaaagagacaaagactagggaccactatttcttacagttcccctcat

SEQ ID NO: 25 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 26 - DNA, 462 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatg

SEQ ID NO: 27 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 28 - DNA, 468 bp, Artificial; identical to SEQ ID NO: 21
  TaSBEIIa-A allele with mutations introduced by TALEN pair TaSBEIIa_T01

SEQ ID NO: 29 - DNA, 458 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggacgtgcagaaacttgaatcattctagaacctgactcaaggcatgtggaacgaatcactgatggtgtaaccaaaggagttaaggaactagtcgtgggggagaaaccgcagagttgtcccaaaccaggagatggggcagaaaaatatacgagattgacccaacgagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 30 - DNA, 440 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagtt

SEQ ID NO: 31 - DNA, 446 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatg

SEQ ID NO: 32 - DNA, 467 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 33 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 34 - DNA, 459 bp, Artificial; identical to SEQ ID NO: 19
  TaSBEIIa-A allele with mutations introduced by TALEN pair TaSBEIIa_T01

SEQ ID NO: 35 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 36 - DNA, 464 bp, Artificial; identical to SEQ ID NO: 15
  TaSBEIIa-A allele with mutations introduced by TALEN pair TaSBEIIa_T01

SEQ ID NO: 37 - DNA, 467 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 38 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 39 - DNA, 445 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttcccc

SEQ ID NO: 40 - DNA, 469 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 41 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctttcgagcatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 42 - DNA, 464 bp, Artificial; identical to SEQ ID NO: 15
  TaSBEIIa-A allele with mutations introduced by TALEN pair TaSBEIIa_T01

SEQ ID NO: 43 - DNA, 426 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaaccaggagatgggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggaccacta

SEQ ID NO: 44 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctgg

SEQ ID NO: 45 - DNA, 461 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 46 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 47 - DNA, 458 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 48 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggccactattttcttacagttccctcatggtctgagaatatgctgga

SEQ ID NO: 49 - DNA, 446 bp, Artificial; identical to SEQ ID NO: 31
  TaSBEIIa-A allele with mutations introduced by TALEN pair TaSBEIIa_T01

SEQ ID NO: 50 - DNA, 460 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaata

SEQ ID NO: 51 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgaattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 52 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactaccggtaatgcctacccgctactttcgctcattttgaattaaggtcctttcgtcatgcaaatttggggaacatcaaagagacaaaagactagggaccactatttcttacagttcccctcatggtctgagaatatgct

SEQ ID NO: 53 - DNA, 459 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgcgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaaccaggagatggggcagaaaatatacgagattgacccaacgcagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 54 - DNA, 467 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcaattctagaacctgactcaaggcattgtggaaacgaatcactgatggtgtaaccaaaggagttaaggaactagtcgtgggggagaaaccgcgagttgtcccaaaaccaggagatggggcagaaaaatatacgagattgacccaacgctgattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 55 - DNA, 409 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacattttcggagccatcttgactaccggtaatgcctacccgctactttcgctcattttgaattaaggtcctttcgtcatgcaaatttggggaacatcaaagagacaa

SEQ ID NO: 56 - DNA, 467 bp, Artificial; identical to SEQ ID NO: 32
  TaSBEIIa-A allele with mutations introduced by TALEN pair TaSBEIIa_T01

SEQ ID NO: 57 - DNA, 446 bp, Artificial; identical to SEQ ID NO: 31
  TaSBEIIa-A allele with mutations introduced by TALEN pair TaSBEIIa_T01

SEQ ID NO: 58 - DNA, 469 bp, Artificial; identical to SEQ ID NO: 40
  TaSBEIIa-A allele with mutations introduced by TALEN pair TaSBEIIa_T01

SEQ ID NO: 59 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgcaggg

SEQ ID NO: 60 - DNA, 469 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctggga

SEQ ID NO: 61 - DNA, 468 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 62 - DNA, 439 bp, Artificial
  TaSBEIIa-A allele with mutations introduced by TALEN pair TaSBEIIa_T01
  misc_feature (412): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggacgtgcagaaaacttgaatcattcagaacctgactcaagcatgtggaacgaatcactgatggtgtaaccaaaggagttaaggaactagtcgtgggggagaaaccgcgagttgtcccaaaaccaggagatggggcagaaaaatatacgagattcggagccatcttgactaccggtaatgcctacccgctactttcgctcattttgaattaaggtcctttcgtcatgcaaatttgggaacatcaaagagagcaaagactagggacccaactntttcttacagttcccctcatggtctgc

SEQ ID NO: 63 - DNA, 468 bp, Artificial; identical to SEQ ID NO: 23
  TaSBEIIa-A allele with mutations introduced by TALEN pair TaSBEIIa_T01

SEQ ID NO: 64 - DNA, 467 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaacctgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 65 - DNA, 465 bp, Artificial; identical to SEQ ID NO: 33
  TaSBEIIa-A allele with mutations introduced by TALEN pair TaSBEIIa_T01

SEQ ID NO: 66 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcaattctagaacctgactcaagcatgtggaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 67 - DNA, 462 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 68 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcatcatgcaaatttggggaacatcaaagaggcaaagactagggaccactatttcatacagttcccctcatggtctgagaatatgctggga

SEQ ID NO: 69 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 70 - DNA, 458 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgag

SEQ ID NO: 71 - DNA, 465 bp, Artificial; identical to SEQ ID NO: 35
  TaSBEIIa-A allele with mutations introduced by TALEN pair TaSBEIIa_T01

SEQ ID NO: 72 - DNA, 470 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattctagaacctgactcaaggcattgtggaaacgaatcactgatggtgtaaccaaaggagttaaggaactagtcgtgggggagaaaccgcgagttgtcccaaaaccaggagatggggcagaaaaatatacgagattgacccaacgctgaattattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 73 - DNA, 462 bp, Artificial; identical to SEQ ID NO: 67
  TaSBEIIa-A allele with mutations introduced by TALEN pair TaSBEIIa_T01

SEQ ID NO: 74 - DNA, 461 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 75 - DNA, 464 bp, Artificial; identical to SEQ ID NO: 15
  TaSBEIIa-A allele with mutations introduced by TALEN pair TaSBEIIa_T01

SEQ ID NO: 76 - DNA, 462 bp, Artificial; identical to SEQ ID NO: 67
  TaSBEIIa-A allele with mutations introduced by TALEN pair TaSBEIIa_T01

SEQ ID NO: 77 - DNA, 468 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgaattgttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 78 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcgaaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 79 - DNA, 466 bp, Artificial; identical to SEQ ID NO: 25
  TaSBEIIa-A allele with mutations introduced by TALEN pair TaSBEIIa_T01

SEQ ID NO: 80 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 81 - DNA, 507 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctcagtggaacgaaaactcacgttaagggattttggtcatgagattatcattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatat

SEQ ID NO: 82 - DNA, 465 bp, Artificial; identical to SEQ ID NO: 51
  TaSBEIIa-A allele with mutations introduced by TALEN pair TaSBEIIa_T01

SEQ ID NO: 83 - DNA, 464 bp, Artificial; identical to SEQ ID NO: 15
  TaSBEIIa-A allele with mutations introduced by TALEN pair TaSBEIIa_T01

SEQ ID NO: 84 - DNA, 467 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgaattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 85 - DNA, 459 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgagccatcttgactaccggtaatgcctacccgctactttcgctcattttgaattaaggtcctttcgtcatgcaaatttggggaacatcaaagagacaaagactagggaccactattttctttacagttcccctcatggtctgagaatatgctggga

SEQ ID NO: 86 - DNA, 467 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccggttactttcgctcattttgaattaaggtcctttcgtcatgcaaatttggggaacatcaaagagacaaagactagggaccactattttcttacagttcccctcatggtctgagaatatgctgga

SEQ ID NO: 87 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaccgcagagttgcatcccaaaccgaggagatgggcaagaaaatatacgagattgacccaacgcttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 88 - DNA, 462 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcaattctagaacctgactcaagcattgtggaaacgaatcactgatggtgtaaccaaaggagttaaggaactagtcgtgggggagaaaccgcagagttgtcccaaaaccaggagatggggcagaaaatatacagagattgacccaacgctgatttttcggagccatcttgactaccggtaatgcctacccgctactttcgctcattttgaattaaggtcctttcgtcatgcaaatttggggaacatcaaagagacaaagactagggaccactatttcttacagttcccctcatggtctgag

SEQ ID NO: 89 - DNA, 467 bp, Artificial; identical to SEQ ID NO: 32
  TaSBEIIa-A allele with mutations introduced by TALEN pair TaSBEIIa_T01

SEQ ID NO: 90 - DNA, 468 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctttttcggagccatcttgactaccggtaatgcctacccgctactttcgctcattttgaattaaggtcctttcgtcatgcaaatttggggaacatcaaagagacaaagacttagggaccactattttcttacagttcccctcatggtctgagaatatgctggga

SEQ ID NO: 91 - DNA, 458 bp, Artificial; identical to SEQ ID NO: 47
  TaSBEIIa-A allele with mutations introduced by TALEN pair TaSBEIIa_T01

SEQ ID NO: 92 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 93 - DNA, 468 bp, Artificial; identical to SEQ ID NO: 23
  TaSBEIIa-A allele with mutations introduced by TALEN pair TaSBEIIa_T01

SEQ ID NO: 94 - DNA, 459 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 95 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 96 - DNA, 468 bp, Artificial; identical to SEQ ID NO: 23
  TaSBEIIa-A allele with mutations introduced by TALEN pair TaSBEIIa_T01

SEQ ID NO: 97 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 98 - DNA, 469 bp, Artificial; identical to SEQ ID NO: 40
  TaSBEIIa-A allele with mutations introduced by TALEN pair TaSBEIIa_T01

SEQ ID NO: 99 - DNA, 463 bp, Artificial; identical to SEQ ID NO: 18
  TaSBEIIa-A allele with mutations introduced by TALEN pair TaSBEIIa_T01

SEQ ID NO: 100 - DNA, 459 bp, Artificial; identical to SEQ ID NO: 94
  TaSBEIIa-A allele with mutations introduced by TALEN pair TaSBEIIa_T01

SEQ ID NO: 101 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 102 - DNA, 466 bp, Artificial; identical to SEQ ID NO: 80
  TaSBEIIa-A allele with mutations introduced by TALEN pair TaSBEIIa_T01

SEQ ID NO: 103 - DNA, 456 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttcccctcatggtctgag

SEQ ID NO: 104 - DNA, 464 bp, Artificial; identical to SEQ ID NO: 15
  TaSBEIIa-A allele with mutations introduced by TALEN pair TaSBEIIa_T01

SEQ ID NO: 105 - DNA, 445 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatg

SEQ ID NO: 106 - DNA, 464 bp, Artificial; identical to SEQ ID NO: 27
  TaSBEIIa-A allele with mutations introduced by TALEN pair TaSBEIIa_T01

SEQ ID NO: 107 - DNA, 448 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcagagttgtcccaaaccaaggagatggggcagaaaaatatgacagagattgacccaatcgccatgattttcggagccatcttgactaccggtaatgcctacccgctactttcgctcattttgaattaaggtcctttcgtcatgcaaatttggggaacatcaaagagacaaagactagggaccactatttcttacagtt

SEQ ID NO: 108 - DNA, 431 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattcggagccatcttgactaccggtaatgcctacccgctactttcgctcattttgaattaaggtcctttcgtcatgcaaatttggggaacatcaaagagacaaagactagggaccactatttcttacagttcccctcat

SEQ ID NO: 109 - DNA, 462 bp, Artificial; identical to SEQ ID NO: 67
  TaSBEIIa-A allele with mutations introduced by TALEN pair TaSBEIIa_T01

SEQ ID NO: 110 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 111 - DNA, 463 bp, Artificial
  TaSBEIIa-A allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 112 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 113 - DNA, 464 bp, Artificial; identical to SEQ ID NO: 15
  TaSBEIIa-A allele with mutations introduced by TALEN pair TaSBEIIa_T01

SEQ ID NO: 114 - DNA, 431 bp, Artificial; identical to SEQ ID NO: 108
  TaSBEIIa-A allele with mutations introduced by TALEN pair TaSBEIIa_T01

SEQ ID NO: 115 - DNA, 452 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttcggagccatcttgactaccggtaatgcctacccgctactttcgctcattttgaattaaggtcctttcgtcatgcaaatttggggaacatcaaagagacaaagactagggaccactattttcttacagttcccctcatggtctgag

SEQ ID NO: 116 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctggga

SEQ ID NO: 117 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgaattttcggagccatcttgactaccggtaatgctaccgcctactttcgctcattttgaattaaggtcctttcgtcatgcaaatttggggaacatcaaagagacaaagactagggaccactatttcttacagttcccctcatggtctgagaatatgct

SEQ ID NO: 118 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggttgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 119 - DNA, 466 bp, Artificial; identical to SEQ ID NO: 80
  TaSBEIIa-A allele with mutations introduced by TALEN pair TaSBEIIa_T01

SEQ ID NO: 120 - DNA, 432 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattcggagccatcttgactaccggtaatgcctacccgctactttcgctcattttgaattaaggtcctttcgtcatgcaaatttggggaacatcaaagagacaaagactagggaccactatttcttacagttcccctcat

SEQ ID NO: 121 - DNA, 464 bp, Artificial; identical to SEQ ID NO: 15
  TaSBEIIa-A allele with mutations introduced by TALEN pair TaSBEIIa_T01

SEQ ID NO: 122 - DNA, 463 bp, Artificial; identical to SEQ ID NO: 101
  TaSBEIIa-A allele with mutations introduced by TALEN pair TaSBEIIa_T01

SEQ ID NO: 123 - DNA, 445 bp, Artificial; identical to SEQ ID NO: 105
  TaSBEIIa-A allele with mutations introduced by TALEN pair TaSBEIIa_T01

SEQ ID NO: 124 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggg

SEQ ID NO: 125 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 126 - DNA, 465 bp, Artificial; identical to SEQ ID NO: 51
  TaSBEIIa-A allele with mutations introduced by TALEN pair TaSBEIIa_T01

SEQ ID NO: 127 - DNA, 460 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaaccaggagatggggcagaaaaatatacgagattgacccaacgagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 128 - DNA, 463 bp, Artificial; identical to SEQ ID NO: 101
  TaSBEIIa-A allele with mutations introduced by TALEN pair TaSBEIIa_T01

SEQ ID NO: 129 - DNA, 415 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattcggagccatcttgactaccggtaatgcctacccgctactttcgctcattttgaattaaggtcctttcgtcatgcaaatttggggaacatcaaagagacaaagactagggaccactatttc

SEQ ID NO: 130 - DNA, 464 bp, Artificial; identical to SEQ ID NO: 15
  TaSBEIIa-A allele with mutations introduced by TALEN pair TaSBEIIa_T01

SEQ ID NO: 131 - DNA, 470 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcatgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 132 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggg

SEQ ID NO: 133 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaaccaggagatgggcagaaaaatatacgagattgacccaacattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 134 - DNA, 413 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagac

SEQ ID NO: 135 - DNA, 468 bp, Artificial; identical to SEQ ID NO: 23
  TaSBEIIa-A allele with mutations introduced by TALEN pair TaSBEIIa_T01

SEQ ID NO: 136 - DNA, 458 bp, Artificial; identical to SEQ ID NO: 47
  TaSBEIIa-A allele with mutations introduced by TALEN pair TaSBEIIa_T01

SEQ ID NO: 137 - DNA, 465 bp, Artificial; identical to SEQ ID NO: 51
  TaSBEIIa-A allele with mutations introduced by TALEN pair TaSBEIIa_T01

SEQ ID NO: 138 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctgga

SEQ ID NO: 139 - DNA, 464 bp, Artificial; identical to SEQ ID NO: 15
  TaSBEIIa-A allele with mutations introduced by TALEN pair TaSBEIIa_T01

SEQ ID NO: 140 - DNA, 469 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattctagaacctgactcaaggcattgtggaacgaatcactgatggtgtaaccaaaggagttaaggaactagtcgtgggggagaaaccgcgagttgtcccaaaaccaggagatggggcagaaaaatatacgagattgacccaacgcttttcggatgccatcttgactaccggtaatgcctacccgctactttcgctcattttgaattaaggtccttcgttcatgcaaatttggggaacatcaaagagacaaagactagggaccactatttcttacagttcccctcatggtctgagaatatgctggga

SEQ ID NO: 141 - DNA, 463 bp, Artificial; identical to SEQ ID NO: 101
  TaSBEIIa-A allele with mutations introduced by TALEN pair TaSBEIIa_T01

SEQ ID NO: 142 - DNA, 462 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatg

SEQ ID NO: 143 - DNA, 459 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 144 - DNA, 458 bp, Artificial; identical to SEQ ID NO: 47
  TaSBEIIa-A allele with mutations introduced by TALEN pair TaSBEIIa_T01

SEQ ID NO: 145 - DNA, 467 bp, Artificial; identical to SEQ ID NO: 84
  TaSBEIIa-A allele with mutations introduced by TALEN pair TaSBEIIa_T01

SEQ ID NO: 146 - DNA, 447 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatg

SEQ ID NO: 147 - DNA, 466 bp, Artificial; identical to SEQ ID NO: 25
  TaSBEIIa-A allele with mutations introduced by TALEN pair TaSBEIIa_T01

SEQ ID NO: 148 - DNA, 468 bp, Artificial; identical to SEQ ID NO: 23
  TaSBEIIa-A allele with mutations introduced by TALEN pair TaSBEIIa_T01

SEQ ID NO: 149 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 150 - DNA, 459 bp, Artificial; identical to SEQ ID NO: 143
  TaSBEIIa-A allele with mutations introduced by TALEN pair TaSBEIIa_T01

SEQ ID NO: 151 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattctagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 152 - DNA, 467 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 153 - DNA, 464 bp, Artificial; identical to SEQ ID NO: 69
  TaSBEIIa-A allele with mutations introduced by TALEN pair TaSBEIIa_T01

SEQ ID NO: 154 - DNA, 464 bp, Artificial; identical to SEQ ID NO: 15
  TaSBEIIa-A allele with mutations introduced by TALEN pair TaSBEIIa_T01

SEQ ID NO: 155 - DNA, 469 bp, Artificial; identical to SEQ ID NO: 40
  TaSBEIIa-A allele with mutations introduced by TALEN pair TaSBEIIa_T01

SEQ ID NO: 156 - DNA, 470 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaaagacatcggaggaaggcaaacaggctgaaagtaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 157 - DNA, 464 bp, Artificial; identical to SEQ ID NO: 15
  TaSBEIIa-A allele with mutations introduced by TALEN pair TaSBEIIa_T01

SEQ ID NO: 158 - DNA, 555 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcaccgaaacgcgcgacacgaaagggcctcgtgaaaacgtggcggcgtgaccgcagtggaggcagtgcatgcatggcgcaatgcactgacgggattttcggagccatcttgactaccggtaatgcctacccgctactttcgctcatttgaattaaggtcctttcgtcatgcaaatttggggaacatcaaagagacaaagactagggaccactatttcttacagttcccctcatggtctgagaaatgctggga

SEQ ID NO: 159 - DNA, 464 bp, Artificial; identical to SEQ ID NO: 15
  TaSBEIIa-A allele with mutations introduced by TALEN pair TaSBEIIa_T01

SEQ ID NO: 160 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaatatacagagattgacccaacgacgccaatcttgactaccggtaatgcctacccgctactttctgctcatttttgaaattaaggtcctttcgtcatgcaaatttggggaacatcaaagagacaaagactagggaccactattttcttacagttcccctcatggtctgagaatatgctggga

SEQ ID NO: 161 - DNA, 412 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcgaaaaatatacgagattgacccaacgcttttcggagccatcttgactaccggtaatgcctacccgcactttcgcttcattttgaattaaggtcctttcgtcagcaatttggggaacatcaaagagacaaagacta

SEQ ID NO: 162 - DNA, 466 bp, Artificial; identical to SEQ ID NO: 80
  TaSBEIIa-A allele with mutations introduced by TALEN pair TaSBEIIa_T01

SEQ ID NO: 163 - DNA, 464 bp, Artificial; identical to SEQ ID NO: 15
  TaSBEIIa-A allele with mutations introduced by TALEN pair TaSBEIIa_T01

SEQ ID NO: 164 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaacaatcactgatggtgtaaccaaaggagttaaggaactagtcgtgggggagaaaccgcgagttgtcccaaaaccaggagatggggcagaaaaatatacgagattgacccaacgctgattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 165 - DNA, 460 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 166 - DNA, 465 bp, Artificial; identical to SEQ ID NO: 33
  TaSBEIIa-A allele with mutations introduced by TALEN pair TaSBEIIa_T01

SEQ ID NO: 167 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacgaatcactgatggtgtaaccaaaggagttaaggaactagtcgtgggggagaaaccgcgagttgtcccaaaaccaggagatggggcagaaaaatatacgagattgacccaacgctgattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 168 - DNA, 467 bp, Artificial; identical to SEQ ID NO: 37
  TaSBEIIa-A allele with mutations introduced by TALEN pair TaSBEIIa_T01

SEQ ID NO: 169 - DNA, 467 bp, Artificial; identical to SEQ ID NO: 37
  TaSBEIIa-A allele with mutations introduced by TALEN pair TaSBEIIa_T01

SEQ ID NO: 170 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgaattgttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 171 - DNA, 468 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattctagaacctgactcaaggcattgtggaaacgaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 172 - DNA, 466 bp, Artificial; identical to SEQ ID NO: 80
  TaSBEIIa-A allele with mutations introduced by TALEN pair TaSBEIIa_T01

SEQ ID NO: 173 - DNA, 463 bp, Artificial; identical to SEQ ID NO: 101
  TaSBEIIa-A allele with mutations introduced by TALEN pair TaSBEIIa_T01

SEQ ID NO: 174 - DNA, 465 bp, Artificial; identical to SEQ ID NO: 92
  TaSBEIIa-A allele with mutations introduced by TALEN pair TaSBEIIa_T01

SEQ ID NO: 175 - DNA, 468 bp, Artificial; identical to SEQ ID NO: 23
  TaSBEIIa-A allele with mutations introduced by TALEN pair TaSBEIIa_T01

SEQ ID NO: 176 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 177 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacattttcggagccatcttgactaccggtaatgcctacccgctactttcgctcattttgaaattaaggtcctttcgtcatgcaaatttggggaacatcaaagagacaaagactagggaccactattttcttacagttcccctcatggtctgagaatatgctggga

SEQ ID NO: 178 - DNA, 467 bp, Artificial; identical to SEQ ID NO: 37
  TaSBEIIa-A allele with mutations introduced by TALEN pair TaSBEIIa_T01

SEQ ID NO: 179 - DNA, 468 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcatgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 180 - DNA, 468 bp, Artificial; identical to SEQ ID NO: 23
  TaSBEIIa-A allele with mutations introduced by TALEN pair TaSBEIIa_T01

SEQ ID NO: 181 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagaacaaagacttagggaccactattttcttacagttcccctcatggtctgagaatatgctggga

SEQ ID NO: 182 - DNA, 461 bp, Artificial; identical to SEQ ID NO: 74
  TaSBEIIa-A allele with mutations introduced by TALEN pair TaSBEIIa_T01

SEQ ID NO: 183 - DNA, 468 bp, Artificial; identical to SEQ ID NO: 23
  TaSBEIIa-A allele with mutations introduced by TALEN pair TaSBEIIa_T01

SEQ ID NO: 184 - DNA, 439 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacag

SEQ ID NO: 185 - DNA, 465 bp, Artificial; identical to SEQ ID NO: 35
  TaSBEIIa-A allele with mutations introduced by TALEN pair TaSBEIIa_T01

SEQ ID NO: 186 - DNA, 464 bp, Artificial; identical to SEQ ID NO: 15
  TaSBEIIa-A allele with mutations introduced by TALEN pair TaSBEIIa_T01

SEQ ID NO: 187 - DNA, 465 bp, Artificial; identical to SEQ ID NO: 38
  TaSBEIIa-A allele with mutations introduced by TALEN pair TaSBEIIa_T01

SEQ ID NO: 188 - DNA, 423 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattcggagccatcttgactaccggtaatgcctacccgctactttcgctcattttgaattaaggtcctttcgtcatgcaaatttggggaacatcaaagagacaaagactagggaccactatttcttacagtt

SEQ ID NO: 189 - DNA, 466 bp, Artificial; identical to SEQ ID NO: 25
  TaSBEIIa-A allele with mutations introduced by TALEN pair TaSBEIIa_T01

SEQ ID NO: 190 - DNA, 460 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctttttcggagccatcttgactaccggtaatgcctacccgctactttcgctcattttgaattaaggtcctttcgtcatgcaaatttggggaacatcaaagagacaaagacttagggaccactattttcttacagttcccctcatggtctgagaata

SEQ ID NO: 191 - DNA, 459 bp, Artificial; identical to SEQ ID NO: 143
  TaSBEIIa-A allele with mutations introduced by TALEN pair TaSBEIIa_T01

SEQ ID NO: 192 - DNA, 461 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatgc

SEQ ID NO: 193 - DNA, 464 bp, Artificial; identical to SEQ ID NO: 15
  TaSBEIIa-A allele with mutations introduced by TALEN pair TaSBEIIa_T01

SEQ ID NO: 194 - DNA, 465 bp, Artificial; identical to SEQ ID NO: 35
  TaSBEIIa-A allele with mutations introduced by TALEN pair TaSBEIIa_T01

SEQ ID NO: 195 - DNA, 463 bp, Artificial; identical to SEQ ID NO: 101
  TaSBEIIa-A allele with mutations introduced by TALEN pair TaSBEIIa_T01

SEQ ID NO: 196 - DNA, 461 bp, Artificial; identical to SEQ ID NO: 45
  TaSBEIIa-A allele with mutations introduced by TALEN pair TaSBEIIa_T01

SEQ ID NO: 197 - DNA, 466 bp, Artificial; identical to SEQ ID NO: 25
  TaSBEIIa-A allele with mutations introduced by TALEN pair TaSBEIIa_T01

SEQ ID NO: 198 - DNA, 464 bp, Artificial; identical to SEQ ID NO: 69
  TaSBEIIa-A allele with mutations introduced by TALEN pair TaSBEIIa_T01

SEQ ID NO: 199 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaaccaggagatggggcagaaaaatatacgagattgacccaatttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 200 - DNA, 445 bp, Artificial; identical to SEQ ID NO: 105
  TaSBEIIa-A allele with mutations introduced by TALEN pair TaSBEIIa_T01

SEQ ID NO: 201 - DNA, 461 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggccgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatat

SEQ ID NO: 202 - DNA, 465 bp, Artificial; identical to SEQ ID NO: 35
  TaSBEIIa-A allele with mutations introduced by TALEN pair TaSBEIIa_T01

SEQ ID NO: 203 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaacctgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 204 - DNA, 464 bp, Artificial; identical to SEQ ID NO: 15
  TaSBEIIa-A allele with mutations introduced by TALEN pair TaSBEIIa_T01

SEQ ID NO: 205 - DNA, 466 bp, Artificial; identical to SEQ ID NO: 80
  TaSBEIIa-A allele with mutations introduced by TALEN pair TaSBEIIa_T01

SEQ ID NO: 206 - DNA, 468 bp, Artificial; identical to SEQ ID NO: 23
  TaSBEIIa-A allele with mutations introduced by TALEN pair TaSBEIIa_T01

SEQ ID NO: 207 - DNA, 469 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 208 - DNA, 465 bp, Artificial; identical to SEQ ID NO: 33
  TaSBEIIa-A allele with mutations introduced by TALEN pair TaSBEIIa_T01

SEQ ID NO: 209 - DNA, 466 bp, Artificial; identical to SEQ ID NO: 112
  TaSBEIIa-A allele with mutations introduced by TALEN pair TaSBEIIa_T01

SEQ ID NO: 210 - DNA, 469 bp, Artificial; identical to SEQ ID NO: 60
  TaSBEIIa-A allele with mutations introduced by TALEN pair TaSBEIIa_T01

SEQ ID NO: 211 - DNA, 465 bp, Artificial; identical to SEQ ID NO: 35
  TaSBEIIa-A allele with mutations introduced by TALEN pair TaSBEIIa_T01

SEQ ID NO: 212 - DNA, 468 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgtgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 213 - DNA, 431 bp, Artificial; identical to SEQ ID NO: 108
  TaSBEIIa-A allele with mutations introduced by TALEN pair TaSBEIIa_T01

SEQ ID NO: 214 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggagggactgcagaaaaacttgaatctttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 215 - DNA, 458 bp, Artificial; identical to SEQ ID NO: 47
  TaSBEIIa-A allele with mutations introduced by TALEN pair TaSBEIIa_T01

SEQ ID NO: 216 - DNA, 459 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatgggcagaaaaatatacgagattgacccaacgcagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 217 - DNA, 464 bp, Artificial; identical to SEQ ID NO: 15
  TaSBEIIa-A allele with mutations introduced by TALEN pair TaSBEIIa_T01

SEQ ID NO: 218 - DNA, 464 bp, Artificial; identical to SEQ ID NO: 15
  TaSBEIIa-A allele with mutations introduced by TALEN pair TaSBEIIa_T01

SEQ ID NO: 219 - DNA, 468 bp, Artificial; identical to SEQ ID NO: 23
  TaSBEIIa-A allele with mutations introduced by TALEN pair TaSBEIIa_T01

SEQ ID NO: 220 - DNA, 467 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagacttagggaccactattttcttacagttcccctcatggtctgagaatatgctggga

SEQ ID NO: 221 - DNA, 556 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcaccgaaacgcgcgacacgaaagggcctcgtgaaaacgtggcggcgtgaccgcagtggaggcagtgcatgcatggcgcaatgcactgacgggattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaaatgctggga

SEQ ID NO: 222 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggccactattttcttacagttccctcatggtctgagaatatgctggga

SEQ ID NO: 223 - DNA, 464 bp, Artificial; identical to SEQ ID NO: 69
  TaSBEIIa-A allele with mutations introduced by TALEN pair TaSBEIIa_T01

SEQ ID NO: 224 - DNA, 470 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 225 - DNA, 464 bp, Artificial; identical to SEQ ID NO: 15
  TaSBEIIa-A allele with mutations introduced by TALEN pair TaSBEIIa_T01

SEQ ID NO: 226 - DNA, 460 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatat

SEQ ID NO: 227 - DNA, 471 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcaggaaccgactcaaggcattgtggaaacaatcactgatggtgtaaccaaaggagttaaggaactagtcgtgggggagaaaccgcgagttgtcccaaaaccaggagatggggccagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctggga

SEQ ID NO: 228 - DNA, 431 bp, Artificial; identical to SEQ ID NO: 108
  TaSBEIIa-A allele with mutations introduced by TALEN pair TaSBEIIa_T01

SEQ ID NO: 229 - DNA, 461 bp, Artificial; identical to SEQ ID NO: 45
  TaSBEIIa-A allele with mutations introduced by TALEN pair TaSBEIIa_T01

SEQ ID NO: 230 - DNA, 460 bp, Artificial; identical to SEQ ID NO: 165
  TaSBEIIa-A allele with mutations introduced by TALEN pair TaSBEIIa_T01

SEQ ID NO: 231 - DNA, 424 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctatttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgtttcggagccatcttgactaccggtaatgcctacccgctactttcgctcattttgaattaaggtccttcgtcatgcaaatttggggaacatcaaagagacaaagactagggaccacta

SEQ ID NO: 232 - DNA, 464 bp, Artificial; identical to SEQ ID NO: 15
  TaSBEIIa-A allele with mutations introduced by TALEN pair TaSBEIIa_T01

SEQ ID NO: 233 - DNA, 467 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaccttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 234 - DNA, 458 bp, Artificial; identical to SEQ ID NO: 47
  TaSBEIIa-A allele with mutations introduced by TALEN pair TaSBEIIa_T01

SEQ ID NO: 235 - DNA, 465 bp, Artificial; identical to SEQ ID NO: 35
  TaSBEIIa-A allele with mutations introduced by TALEN pair TaSBEIIa_T01

SEQ ID NO: 236 - DNA, 464 bp, Artificial; identical to SEQ ID NO: 15
  TaSBEIIa-A allele with mutations introduced by TALEN pair TaSBEIIa_T01

SEQ ID NO: 237 - DNA, 468 bp, Artificial; identical to SEQ ID NO: 23
  TaSBEIIa-A allele with mutations introduced by TALEN pair TaSBEIIa_T01

SEQ ID NO: 238 - DNA, 467 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctggga

SEQ ID NO: 239 - DNA, 460 bp, Artificial; identical to SEQ ID NO: 127
  TaSBEIIa-A allele with mutations introduced by TALEN pair TaSBEIIa_T01

SEQ ID NO: 240 - DNA, 458 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaata

SEQ ID NO: 241 - DNA, 467 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggaacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 242 - DNA, 470 bp, Artificial; identical to SEQ ID NO: 224
  TaSBEIIa-A allele with mutations introduced by TALEN pair TaSBEIIa_T01

SEQ ID NO: 243 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 244 - DNA, 464 bp, Artificial; identical to SEQ ID NO: 15
  TaSBEIIa-A allele with mutations introduced by TALEN pair TaSBEIIa_T01

SEQ ID NO: 245 - DNA, 468 bp, Artificial; identical to SEQ ID NO: 23
  TaSBEIIa-A allele with mutations introduced by TALEN pair TaSBEIIa_T01

SEQ ID NO: 246 - DNA, 466 bp, Artificial; identical to SEQ ID NO: 25
  TaSBEIIa-A allele with mutations introduced by TALEN pair TaSBEIIa_T01

SEQ ID NO: 247 - DNA, 460 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 248 - DNA, 468 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 249 - DNA, 459 bp, Artificial; identical to SEQ ID NO: 143
  TaSBEIIa-A allele with mutations introduced by TALEN pair TaSBEIIa_T01

SEQ ID NO: 250 - DNA, 468 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 251 - DNA, 464 bp, Artificial; identical to SEQ ID NO: 15
  TaSBEIIa-A allele with mutations introduced by TALEN pair TaSBEIIa_T01

SEQ ID NO: 252 - DNA, 431 bp, Artificial; identical to SEQ ID NO: 108
  TaSBEIIa-A allele with mutations introduced by TALEN pair TaSBEIIa_T01

SEQ ID NO: 253 - DNA, 464 bp, Artificial; identical to SEQ ID NO: 27
  TaSBEIIa-A allele with mutations introduced by TALEN pair TaSBEIIa_T01

SEQ ID NO: 254 - DNA, 464 bp, Artificial; identical to SEQ ID NO: 15
  TaSBEIIa-A allele with mutations introduced by TALEN pair TaSBEIIa_T01

SEQ ID NO: 255 - DNA, 464 bp, Artificial; identical to SEQ ID NO: 15
  TaSBEIIa-A allele with mutations introduced by TALEN pair TaSBEIIa_T01

SEQ ID NO: 256 - DNA, 464 bp, Artificial; identical to SEQ ID NO: 15
  TaSBEIIa-A allele with mutations introduced by TALEN pair TaSBEIIa_T01

SEQ ID NO: 257 - DNA, 468 bp, Artificial; identical to SEQ ID NO: 23
  TaSBEIIa-A allele with mutations introduced by TALEN pair TaSBEIIa_T01

SEQ ID NO: 258 - DNA, 463 bp, Artificial; identical to SEQ ID NO: 101
  TaSBEIIa-A allele with mutations introduced by TALEN pair TaSBEIIa_T01

SEQ ID NO: 259 - DNA, 467 bp, Artificial; identical to SEQ ID NO: 152
  TaSBEIIa-A allele with mutations introduced by TALEN pair TaSBEIIa_T01

SEQ ID NO: 260 - DNA, 464 bp, Artificial; identical to SEQ ID NO: 15
  TaSBEIIa-A allele with mutations introduced by TALEN pair TaSBEIIa_T01

SEQ ID NO: 261 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctatttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 262 - DNA, 445 bp, Artificial; identical to SEQ ID NO: 105
  TaSBEIIa-A allele with mutations introduced by TALEN pair TaSBEIIa_T01

SEQ ID NO: 263 - DNA, 461 bp, Artificial; identical to SEQ ID NO: 45
  TaSBEIIa-A allele with mutations introduced by TALEN pair TaSBEIIa_T01

SEQ ID NO: 264 - DNA, 463 bp, Artificial; identical to SEQ ID NO: 101
  TaSBEIIa-A allele with mutations introduced by TALEN pair TaSBEIIa_T01

SEQ ID NO: 265 - DNA, 464 bp, Artificial; identical to SEQ ID NO: 15
  TaSBEIIa-A allele with mutations introduced by TALEN pair TaSBEIIa_T01

SEQ ID NO: 266 - DNA, 466 bp, Artificial; identical to SEQ ID NO: 112
  TaSBEIIa-A allele with mutations introduced by TALEN pair TaSBEIIa_T01

SEQ ID NO: 267 - DNA, 438 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattttcttacagtt

SEQ ID NO: 268 - DNA, 458 bp, Artificial; identical to SEQ ID NO: 47
  TaSBEIIa-A allele with mutations introduced by TALEN pair TaSBEIIa_T01

SEQ ID NO: 269 - DNA, 465 bp, Artificial; identical to SEQ ID NO: 92
  TaSBEIIa-A allele with mutations introduced by TALEN pair TaSBEIIa_T01

SEQ ID NO: 270 - DNA, 464 bp, Artificial; identical to SEQ ID NO: 15
  TaSBEIIa-A allele with mutations introduced by TALEN pair TaSBEIIa_T01

SEQ ID NO: 271 - DNA, 464 bp, Artificial; identical to SEQ ID NO: 69
  TaSBEIIa-A allele with mutations introduced by TALEN pair TaSBEIIa_T01

SEQ ID NO: 272 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattcggagccatcttgactaccggtaatgcctacccgctactttcagctcattttgaattaaggtcctttcgtcatgcaaatttggggaacatcaaagagacaaagactagggaccactatttcttacagttcccctcatggtctgagaatatgct

SEQ ID NO: 273 - DNA, 463 bp, Artificial; identical to SEQ ID NO: 101
  TaSBEIIa-A allele with mutations introduced by TALEN pair TaSBEIIa_T01

SEQ ID NO: 274 - DNA, 433 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattcggagccatcttgactaccggtaatgcctacccgctactttcgctcattttgaattaaggtcctttcgtcatgcaaatttggggaacatcaaagagacaaagactagggaccactatttcttacagttcccctcatgg

SEQ ID NO: 275 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagacttagggaccactattttcttacagttcccctcatggtctgagaatatgct

SEQ ID NO: 276 - DNA, 457 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 277 - DNA, 444 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaatatacgagattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatg

SEQ ID NO: 278 - DNA, 461 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaaattaaggtcctttcgtcatgcaaatttggggaacatcaaagagacaaagactagggaccactattttcttacagttcccctcatggtctgagaata

SEQ ID NO: 279 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggg

SEQ ID NO: 280 - DNA, 460 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 281 - DNA, 469 bp, Artificial; identical to SEQ ID NO: 60
  TaSBEIIa-A allele with mutations introduced by TALEN pair TaSBEIIa_T01

SEQ ID NO: 282 - DNA, 464 bp, Artificial; identical to SEQ ID NO: 15
  TaSBEIIa-A allele with mutations introduced by TALEN pair TaSBEIIa_T01

SEQ ID NO: 283 - DNA, 459 bp, Artificial; identical to SEQ ID NO: 143
  TaSBEIIa-A allele with mutations introduced by TALEN pair TaSBEIIa_T01

SEQ ID NO: 284 - DNA, 464 bp, Artificial; identical to SEQ ID NO: 15
  TaSBEIIa-A allele with mutations introduced by TALEN pair TaSBEIIa_T01

SEQ ID NO: 285 - DNA, 459 bp, Artificial; identical to SEQ ID NO: 143
  TaSBEIIa-A allele with mutations introduced by TALEN pair TaSBEIIa_T01

SEQ ID NO: 286 - DNA, 464 bp, Artificial; identical to SEQ ID NO: 69
  TaSBEIIa-A allele with mutations introduced by TALEN pair TaSBEIIa_T01

SEQ ID NO: 287 - DNA, 463 bp, Artificial; identical to SEQ ID NO: 101
  TaSBEIIa-A allele with mutations introduced by TALEN pair TaSBEIIa_T01

SEQ ID NO: 288 - DNA, 466 bp, Artificial; identical to SEQ ID NO: 25
  TaSBEIIa-A allele with mutations introduced by TALEN pair TaSBEIIa_T01

SEQ ID NO: 289 - DNA, 466 bp, Artificial; identical to SEQ ID NO: 80
  TaSBEIIa-A allele with mutations introduced by TALEN pair TaSBEIIa_T01

SEQ ID NO: 290 - DNA, 468 bp, Artificial; identical to SEQ ID NO: 171
  TaSBEIIa-A allele with mutations introduced by TALEN pair TaSBEIIa_T01

SEQ ID NO: 291 - DNA, 470 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaaggagatggggcagaaaaatatgacagagattgacccaatcgcctgatttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 292 - DNA, 464 bp, Artificial; identical to SEQ ID NO: 69
  TaSBEIIa-A allele with mutations introduced by TALEN pair TaSBEIIa_T01

SEQ ID NO: 293 - DNA, 474 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcaattctagaacctgactcaagcattgtggaaacgaatcactgatggtgtaaccaaaggagttaaggaactagtcgtgggggagaaaccgcagagttgtcccaaaaccaaggagatggggcagaaaaatatacagagattgacccaatcgcctgatttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 294 - DNA, 464 bp, Artificial; identical to SEQ ID NO: 69
  TaSBEIIa-A allele with mutations introduced by TALEN pair TaSBEIIa_T01

SEQ ID NO: 295 - DNA, 466 bp, Artificial; identical to SEQ ID NO: 80
  TaSBEIIa-A allele with mutations introduced by TALEN pair TaSBEIIa_T01

SEQ ID NO: 296 - DNA, 465 bp, Artificial; identical to SEQ ID NO: 38
  TaSBEIIa-A allele with mutations introduced by TALEN pair TaSBEIIa_T01

SEQ ID NO: 297 - DNA, 467 bp, Artificial; identical to SEQ ID NO: 220
  TaSBEIIa-A allele with mutations introduced by TALEN pair TaSBEIIa_T01

SEQ ID NO: 298 - DNA, 468 bp, Artificial; identical to SEQ ID NO: 23
  TaSBEIIa-A allele with mutations introduced by TALEN pair TaSBEIIa_T01

SEQ ID NO: 299 - DNA, 462 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttcccctcatggtctggaatatgc

SEQ ID NO: 300 - DNA, 464 bp, Artificial; identical to SEQ ID NO: 95
  TaSBEIIa-A allele with mutations introduced by TALEN pair TaSBEIIa_T01

SEQ ID NO: 301 - DNA, 459 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatat

SEQ ID NO: 302 - DNA, 458 bp, Artificial; identical to SEQ ID NO: 47
  TaSBEIIa-A allele with mutations introduced by TALEN pair TaSBEIIa_T01

SEQ ID NO: 303 - DNA, 466 bp, Artificial; identical to SEQ ID NO: 177
  TaSBEIIa-A allele with mutations introduced by TALEN pair TaSBEIIa_T01

SEQ ID NO: 304 - DNA, 461 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaacgaatcactgatggtgtaaccaaaggagttaaggaactagtcgtgggggagaaaccgcgagttgtcccaaaaccaggagatggggcagaaaaatatacgagattgacccaacgcagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 305 - DNA, 431 bp, Artificial; identical to SEQ ID NO: 108
  TaSBEIIa-A allele with mutations introduced by TALEN pair TaSBEIIa_T01

SEQ ID NO: 306 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacattttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctggga

SEQ ID NO: 307 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 308 - DNA, 463 bp, Artificial; identical to SEQ ID NO: 101
  TaSBEIIa-A allele with mutations introduced by TALEN pair TaSBEIIa_T01

SEQ ID NO: 309 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttcggagccatcttgactaccggtaatgcctacccgctactttcgctcattttgaattaaggtcctttcgtcatgcaaatttggggaacatcaaagagacaaagacttagggaccactattttcttacagttcccctcatggtctgagaatatgctggga

SEQ ID NO: 310 - DNA, 462 bp, Artificial; identical to SEQ ID NO: 67
  TaSBEIIa-A allele with mutations introduced by TALEN pair TaSBEIIa_T01

SEQ ID NO: 311 - DNA, 462 bp, Artificial; identical to SEQ ID NO: 67
  TaSBEIIa-A allele with mutations introduced by TALEN pair TaSBEIIa_T01

SEQ ID NO: 312 - DNA, 460 bp, Artificial; identical to SEQ ID NO: 280
  TaSBEIIa-A allele with mutations introduced by TALEN pair TaSBEIIa_T01

SEQ ID NO: 313 - DNA, 466 bp, Artificial; identical to SEQ ID NO: 25
  TaSBEIIa-A allele with mutations introduced by TALEN pair TaSBEIIa_T01

SEQ ID NO: 314 - DNA, 467 bp, Artificial; identical to SEQ ID NO: 37
  TaSBEIIa-A allele with mutations introduced by TALEN pair TaSBEIIa_T01

SEQ ID NO: 315 - DNA, 463 bp, Artificial; identical to SEQ ID NO: 101
  TaSBEIIa-A allele with mutations introduced by TALEN pair TaSBEIIa_T01

SEQ ID NO: 316 - DNA, 466 bp, Artificial; identical to SEQ ID NO: 25
  TaSBEIIa-A allele with mutations introduced by TALEN pair TaSBEIIa_T01

SEQ ID NO: 317 - DNA, 459 bp, Artificial; identical to SEQ ID NO: 14
  TaSBEIIa-A allele with mutations introduced by TALEN pair TaSBEIIa_T01

SEQ ID NO: 318 - DNA, 466 bp, Artificial; identical to SEQ ID NO: 306
  TaSBEIIa-A allele with mutations introduced by TALEN pair TaSBEIIa_T01

SEQ ID NO: 319 - DNA, 468 bp, Artificial; identical to SEQ ID NO: 23
  TaSBEIIa-A allele with mutations introduced by TALEN pair TaSBEIIa_T01

SEQ ID NO: 320 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctttcggagccatcttgactaccggtaatgcctacccgctactttcgctcattttgaattaaggtcctttcgtcatgcaaatttggggaacatcaaagagacaaagacttagggaccactattttcttacagttcccctcatggtctgagaatatgctggga

SEQ ID NO: 321 - DNA, 463 bp, Artificial; identical to SEQ ID NO: 101
  TaSBEIIa-A allele with mutations introduced by TALEN pair TaSBEIIa_T01

SEQ ID NO: 322 - DNA, 459 bp, Artificial; identical to SEQ ID NO: 143
  TaSBEIIa-A allele with mutations introduced by TALEN pair TaSBEIIa_T01

SEQ ID NO: 323 - DNA, 466 bp, Artificial; identical to SEQ ID NO: 25
  TaSBEIIa-A allele with mutations introduced by TALEN pair TaSBEIIa_T01

SEQ ID NO: 324 - DNA, 464 bp, Artificial; identical to SEQ ID NO: 15
  TaSBEIIa-A allele with mutations introduced by TALEN pair TaSBEIIa_T01

SEQ ID NO: 325 - DNA, 470 bp, Artificial; identical to SEQ ID NO: 224
  TaSBEIIa-A allele with mutations introduced by TALEN pair TaSBEIIa_T01

SEQ ID NO: 326 - DNA, 468 bp, Artificial; identical to SEQ ID NO: 77
  TaSBEIIa-A allele with mutations introduced by TALEN pair TaSBEIIa_T01

SEQ ID NO: 327 - DNA, 445 bp, Artificial; identical to SEQ ID NO: 105
  TaSBEIIa-A allele with mutations introduced by TALEN pair TaSBEIIa_T01

SEQ ID NO: 328 - DNA, 458 bp, Artificial; identical to SEQ ID NO: 47
  TaSBEIIa-A allele with mutations introduced by TALEN pair TaSBEIIa_T01

SEQ ID NO: 329 - DNA, 458 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaaagactagggaccactatttcttacagttcccctcatggtctgag

SEQ ID NO: 330 - DNA, 463 bp, Artificial; identical to SEQ ID NO: 101
  TaSBEIIa-A allele with mutations introduced by TALEN pair TaSBEIIa_T01

SEQ ID NO: 331 - DNA, 412 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattcggagccatcttgactaccggtaatgcctacccgctactttcgctcattttgaattaaggtcctttcgtcatgcaaatttggggaacatcaaagagacaaagactagggaccaact

SEQ ID NO: 332 - DNA, 468 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctaacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 333 - DNA, 464 bp, Artificial; identical to SEQ ID NO: 15
  TaSBEIIa-A allele with mutations introduced by TALEN pair TaSBEIIa_T01

SEQ ID NO: 334 - DNA, 466 bp, Artificial; identical to SEQ ID NO: 25
  TaSBEIIa-A allele with mutations introduced by TALEN pair TaSBEIIa_T01

SEQ ID NO: 335 - DNA, 469 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 336 - DNA, 468 bp, Artificial; identical to SEQ ID NO: 23
  TaSBEIIa-A allele with mutations introduced by TALEN pair TaSBEIIa_T01

SEQ ID NO: 337 - DNA, 459 bp, Artificial; identical to SEQ ID NO: 143
  TaSBEIIa-A allele with mutations introduced by TALEN pair TaSBEIIa_T01

SEQ ID NO: 338 - DNA, 466 bp, Artificial; identical to SEQ ID NO: 25
  TaSBEIIa-A allele with mutations introduced by TALEN pair TaSBEIIa_T01

SEQ ID NO: 339 - DNA, 468 bp, Artificial; identical to SEQ ID NO: 248
  TaSBEIIa-A allele with mutations introduced by TALEN pair TaSBEIIa_T01

SEQ ID NO: 340 - DNA, 458 bp, Artificial; identical to SEQ ID NO: 47
  TaSBEIIa-A allele with mutations introduced by TALEN pair TaSBEIIa_T01

SEQ ID NO: 341 - DNA, 461 bp, Artificial; identical to SEQ ID NO: 192
  TaSBEIIa-A allele with mutations introduced by TALEN pair TaSBEIIa_T01

SEQ ID NO: 342 - DNA, 468 bp, Artificial; identical to SEQ ID NO: 23
  TaSBEIIa-A allele with mutations introduced by TALEN pair TaSBEIIa_T01

SEQ ID NO: 343 - DNA, 465 bp, Artificial; identical to SEQ ID NO: 92
  TaSBEIIa-A allele with mutations introduced by TALEN pair TaSBEIIa_T01

SEQ ID NO: 344 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgaatttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgct

SEQ ID NO: 345 - DNA, 468 bp, Artificial; identical to SEQ ID NO: 248
  TaSBEIIa-A allele with mutations introduced by TALEN pair TaSBEIIa_T01

SEQ ID NO: 346 - DNA, 440 bp, Artificial; identical to SEQ ID NO: 30
  TaSBEIIa-A allele with mutations introduced by TALEN pair TaSBEIIa_T01

SEQ ID NO: 347 - DNA, 468 bp, Artificial; identical to SEQ ID NO: 23
  TaSBEIIa-A allele with mutations introduced by TALEN pair TaSBEIIa_T01

SEQ ID NO: 348 - DNA, 462 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatat

SEQ ID NO: 349 - DNA, 465 bp, Artificial; identical to SEQ ID NO: 38
  TaSBEIIa-A allele with mutations introduced by TALEN pair TaSBEIIa_T01

SEQ ID NO: 350 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctaactttcgctcattttgaattaaggtcctttcgtcatgcaaatttggggaacatcaaagagacaaagactagggaccactattttcttacagttccccctcatggtctgagaatat

SEQ ID NO: 351 - DNA, 462 bp, Artificial; identical to SEQ ID NO: 67
  TaSBEIIa-A allele with mutations introduced by TALEN pair TaSBEIIa_T01

SEQ ID NO: 352 - DNA, 462 bp, Artificial; identical to SEQ ID NO: 67
  TaSBEIIa-A allele with mutations introduced by TALEN pair TaSBEIIa_T01

SEQ ID NO: 353 - DNA, 433 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattcggagccatcttgactaccggtaatgcctacccgctactttcgctcattttgaattaaggtcctttcgtcatgcaaatttggggaacatcaaagagacaaagactagggaccactatttcttacagttcccctcat

SEQ ID NO: 354 - DNA, 466 bp, Artificial; identical to SEQ ID NO: 80
  TaSBEIIa-A allele with mutations introduced by TALEN pair TaSBEIIa_T01

SEQ ID NO: 355 - DNA, 464 bp, Artificial; identical to SEQ ID NO: 27
  TaSBEIIa-A allele with mutations introduced by TALEN pair TaSBEIIa_T01

SEQ ID NO: 356 - DNA, 465 bp, Artificial; identical to SEQ ID NO: 33
  TaSBEIIa-A allele with mutations introduced by TALEN pair TaSBEIIa_T01

SEQ ID NO: 357 - DNA, 462 bp, Artificial; identical to SEQ ID NO: 67
  TaSBEIIa-A allele with mutations introduced by TALEN pair TaSBEIIa_T01

SEQ ID NO: 358 - DNA, 411 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgagccatcttgactaccggtaatgcctacccgctactttcgctcattttgaattaaggtcctttcgtcatgcaaatttggggaacatcaaagagacaaagactaggga

SEQ ID NO: 359 - DNA, 464 bp, Artificial; identical to SEQ ID NO: 15
  TaSBEIIa-A allele with mutations introduced by TALEN pair TaSBEIIa_T01

SEQ ID NO: 360 - DNA, 433 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattcggagccatcttgactaccggtaatgcctacccgctactttcgctcattttgaattaaggtcctttcgtcatgcaaatttggggaacatcaaagagacaaagactagggaccactatttcttacagttccctcatggt

SEQ ID NO: 361 - DNA, 474 bp, Artificial
  TaSBEIIa-A allele with mutations introduced by TALEN pair TaSBEIIa_T01
  misc_feature (249): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggcggtgaaacttgacagaaatctggaaatccttcagacgacagtcaatggcatggaacgaaatcaatcactgatggtgtaaccaaaggagttaaggaactagtcgtggnggaacgaaacgctgtcgatccaaagcagaggaaatggcagaaatatatcgaagccaattcgacccaacgctttgattttcgggagccatcttgactaccggtaatgcctacccgctactttcgctcattttgaattaaggtcctttcgtcatgcaaatttgggaacgaatcaaatgagaacaaagacataggggaccactatttcttacagttcccctcatggtc

SEQ ID NO: 362 - DNA, 465 bp, Artificial; identical to SEQ ID NO: 97
  TaSBEIIa-A allele with mutations introduced by TALEN pair TaSBEIIa_T01

SEQ ID NO: 363 - DNA, 458 bp, Artificial; identical to SEQ ID NO: 47
  TaSBEIIa-A allele with mutations introduced by TALEN pair TaSBEIIa_T01

SEQ ID NO: 364 - DNA, 413 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattcggagccatcttgactaccggtaatgcctacccgctactttcgctcattttgaattaaggtcctttcgtcatgcaaatttggggaacatcaaagagacaaagactagggaccaact

SEQ ID NO: 365 - DNA, 459 bp, Artificial; identical to SEQ ID NO: 85
  TaSBEIIa-A allele with mutations introduced by TALEN pair TaSBEIIa_T01

SEQ ID NO: 366 - DNA, 469 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtccttcgtcatgcaaatttggggaacatcaaagagacaaagactagggaccactattttcttacagttcccctcatggtctgagaatatgctggga

SEQ ID NO: 367 - DNA, 465 bp, Artificial
  TaSBEIIa-A allele with mutations introduced by TALEN pair TaSBEIIa_T01
agatggatgtgcattctagcaagaaacttcacgaaataatgcacttgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattcggagccatcttgactaccggtaatgcctacccgctactttcgctcattttgaattaaggtcctttcgtcatgcaaatttggggaacatcaaagagacaaagactagggaccactatttcttacagttccccctcatggtctgagaatatgct

SEQ ID NO: 368 - DNA, 464 bp, Artificial; identical to SEQ ID NO: 15
  TaSBEIIa-A allele with mutations introduced by TALEN pair TaSBEIIa_T01

SEQ ID NO: 369 - DNA, 463 bp, Artificial; identical to SEQ ID NO: 101
  TaSBEIIa-A allele with mutations introduced by TALEN pair TaSBEIIa_T01

SEQ ID NO: 370 - DNA, 461 bp, Artificial; identical to SEQ ID NO: 45
  TaSBEIIa-A allele with mutations introduced by TALEN pair TaSBEIIa_T01

SEQ ID NO: 371 - DNA, 440 bp, Artificial; identical to SEQ ID NO: 30
  TaSBEIIa-A allele with mutations introduced by TALEN pair TaSBEIIa_T01

SEQ ID NO: 372 - DNA, 468 bp, Artificial; identical to SEQ ID NO: 23
  TaSBEIIa-A allele with mutations introduced by TALEN pair TaSBEIIa_T01

SEQ ID NO: 373 - DNA, 466 bp, Artificial; identical to SEQ ID NO: 25
  TaSBEIIa-A allele with mutations introduced by TALEN pair TaSBEIIa_T01

SEQ ID NO: 374 - DNA, 458 bp, Artificial; identical to SEQ ID NO: 47
  TaSBEIIa-A allele with mutations introduced by TALEN pair TaSBEIIa_T01

SEQ ID NO: 375 - DNA, 463 bp, Artificial; identical to SEQ ID NO: 101
  TaSBEIIa-A allele with mutations introduced by TALEN pair TaSBEIIa_T01

SEQ ID NO: 376 - DNA, 466 bp, Artificial; identical to SEQ ID NO: 25
  TaSBEIIa-A allele with mutations introduced by TALEN pair TaSBEIIa_T01

SEQ ID NO: 377 - DNA, 469 bp, Artificial; identical to SEQ ID NO: 60
  TaSBEIIa-A allele with mutations introduced by TALEN pair TaSBEIIa_T01

SEQ ID NO: 378 - DNA, 462 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctactttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtcccaaaaccaggagatgggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 379 - DNA, 468 bp, Artificial; identical to SEQ ID NO: 248
  TaSBEIIa-A allele with mutations introduced by TALEN pair TaSBEIIa_T01

SEQ ID NO: 380 - DNA, 468 bp, Artificial; identical to SEQ ID NO: 171
  TaSBEIIa-A allele with mutations introduced by TALEN pair TaSBEIIa_T01

SEQ ID NO: 381 - DNA, 466 bp, Artificial; identical to SEQ ID NO: 177
  TaSBEIIa-A allele with mutations introduced by TALEN pair TaSBEIIa_T01

SEQ ID NO: 382 - DNA, 468 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgaattattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 383 - DNA, 466 bp, Artificial; identical to SEQ ID NO: 80
  TaSBEIIa-A allele with mutations introduced by TALEN pair TaSBEIIa_T01

SEQ ID NO: 384 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctttttcggagcctcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 385 - DNA, 468 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctatttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctggga

SEQ ID NO: 386 - DNA, 458 bp, Artificial; identical to SEQ ID NO: 47
  TaSBEIIa-A allele with mutations introduced by TALEN pair TaSBEIIa_T01

SEQ ID NO: 387 - DNA, 465 bp, Artificial; identical to SEQ ID NO: 151
  TaSBEIIa-A allele with mutations introduced by TALEN pair TaSBEIIa_T01

SEQ ID NO: 388 - DNA, 468 bp, Artificial; identical to SEQ ID NO: 23
  TaSBEIIa-A allele with mutations introduced by TALEN pair TaSBEIIa_T01

SEQ ID NO: 389 - DNA, 464 bp, Artificial; identical to SEQ ID NO: 15
  TaSBEIIa-A allele with mutations introduced by TALEN pair TaSBEIIa_T01

SEQ ID NO: 390 - DNA, 459 bp, Artificial; identical to SEQ ID NO: 143
  TaSBEIIa-A allele with mutations introduced by TALEN pair TaSBEIIa_T01

SEQ ID NO: 391 - DNA, 462 bp, Artificial; identical to SEQ ID NO: 67
  TaSBEIIa-A allele with mutations introduced by TALEN pair TaSBEIIa_T01

SEQ ID NO: 392 - DNA, 456 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaagcattgtggaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttcccctcatggtctgag

SEQ ID NO: 393 - DNA, 465 bp, Artificial; identical to SEQ ID NO: 51
  TaSBEIIa-A allele with mutations introduced by TALEN pair TaSBEIIa_T01

SEQ ID NO: 394 - DNA, 458 bp, Artificial; identical to SEQ ID NO: 47
  TaSBEIIa-A allele with mutations introduced by TALEN pair TaSBEIIa_T01

SEQ ID NO: 395 - DNA, 465 bp, Artificial; identical to SEQ ID NO: 97
  TaSBEIIa-A allele with mutations introduced by TALEN pair TaSBEIIa_T01

SEQ ID NO: 396 - DNA, 464 bp, Artificial; identical to SEQ ID NO: 69
  TaSBEIIa-A allele with mutations introduced by TALEN pair TaSBEIIa_T01

SEQ ID NO: 397 - DNA, 463 bp, Artificial; identical to SEQ ID NO: 101
  TaSBEIIa-A allele with mutations introduced by TALEN pair TaSBEIIa_T01

SEQ ID NO: 398 - DNA, 466 bp, Artificial; identical to SEQ ID NO: 25
  TaSBEIIa-A allele with mutations introduced by TALEN pair TaSBEIIa_T01

SEQ ID NO: 399 - DNA, 458 bp, Artificial; identical to SEQ ID NO: 47
  TaSBEIIa-A allele with mutations introduced by TALEN pair TaSBEIIa_T01

SEQ ID NO: 400 - DNA, 463 bp, Artificial; identical to SEQ ID NO: 101
  TaSBEIIa-A allele with mutations introduced by TALEN pair TaSBEIIa_T01

SEQ ID NO: 401 - DNA, 458 bp, Artificial; identical to SEQ ID NO: 47
  TaSBEIIa-A allele with mutations introduced by TALEN pair TaSBEIIa_T01

SEQ ID NO: 402 - DNA, 454 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattttcttacagttcccctcatggtctgag

SEQ ID NO: 403 - DNA, 461 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatat

SEQ ID NO: 404 - DNA, 466 bp, Artificial; identical to SEQ ID NO: 80
  TaSBEIIa-A allele with mutations introduced by TALEN pair TaSBEIIa_T01

SEQ ID NO: 405 - DNA, 458 bp, Artificial; identical to SEQ ID NO: 47
  TaSBEIIa-A allele with mutations introduced by TALEN pair TaSBEIIa_T01

SEQ ID NO: 406 - DNA, 458 bp, Artificial; identical to SEQ ID NO: 47
  TaSBEIIa-A allele with mutations introduced by TALEN pair TaSBEIIa_T01

SEQ ID NO: 407 - DNA, 465 bp, Artificial; identical to SEQ ID NO: 33
  TaSBEIIa-A allele with mutations introduced by TALEN pair TaSBEIIa_T01

SEQ ID NO: 408 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgaatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 409 - DNA, 462 bp, Artificial; identical to SEQ ID NO: 67
  TaSBEIIa-A allele with mutations introduced by TALEN pair TaSBEIIa_T01

SEQ ID NO: 410 - DNA, 467 bp, Artificial; identical to SEQ ID NO: 37
  TaSBEIIa-A allele with mutations introduced by TALEN pair TaSBEIIa_T01

SEQ ID NO: 411 - DNA, 463 bp, Artificial; identical to SEQ ID NO: 101
  TaSBEIIa-A allele with mutations introduced by TALEN pair TaSBEIIa_T01

SEQ ID NO: 412 - DNA, 463 bp, Artificial; identical to SEQ ID NO: 101
  TaSBEIIa-A allele with mutations introduced by TALEN pair TaSBEIIa_T01

SEQ ID NO: 413 - DNA, 458 bp, Artificial; identical to SEQ ID NO: 240
  TaSBEIIa-A allele with mutations introduced by TALEN pair TaSBEIIa_T01

SEQ ID NO: 414 - DNA, 463 bp, Artificial; identical to SEQ ID NO: 101
  TaSBEIIa-A allele with mutations introduced by TALEN pair TaSBEIIa_T01

SEQ ID NO: 415 - DNA, 468 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacattttcggagccatcttgactaccggtaatgcctacccgctactttcgctcattttgaattaaggtcctttcgtcatgcaaatttggggaacatcaaagagacaaagacttagggaccactattttctttacagttccccctcatggtctgagaatatgctggga

SEQ ID NO: 416 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcgaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 417 - DNA, 434 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattctagaacctgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgtttcggagccatcttgactaccggtaatgcctacccgctactttcgctcattttgaattaaggtccttcgttcatcaaaatttggggaacatcaaagagacaaagactagggaccactattttc

SEQ ID NO: 418 - DNA, 468 bp, Artificial; identical to SEQ ID NO: 248
  TaSBEIIa-A allele with mutations introduced by TALEN pair TaSBEIIa_T01

SEQ ID NO: 419 - DNA, 457 bp, Artificial; identical to SEQ ID NO: 276
  TaSBEIIa-A allele with mutations introduced by TALEN pair TaSBEIIa_T01

SEQ ID NO: 420 - DNA, 423 bp, Artificial; identical to SEQ ID NO: 188
  TaSBEIIa-A allele with mutations introduced by TALEN pair TaSBEIIa_T01

SEQ ID NO: 421 - DNA, 556 bp, Artificial; identical to SEQ ID NO: 221
  TaSBEIIa-A allele with mutations introduced by TALEN pair TaSBEIIa_T01

SEQ ID NO: 422 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 423 - DNA, 464 bp, Artificial; identical to SEQ ID NO: 15
  TaSBEIIa-A allele with mutations introduced by TALEN pair TaSBEIIa_T01

SEQ ID NO: 424 - DNA, 470 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgtggaaacaatcactgatggtgtaaccaaaggagttaaggaactagtcgtgggggagaaaccgcgagttgtcccaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctggga

SEQ ID NO: 425 - DNA, 459 bp, Artificial; identical to SEQ ID NO: 143
  TaSBEIIa-A allele with mutations introduced by TALEN pair TaSBEIIa_T01

SEQ ID NO: 426 - DNA, 469 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttttcggagccatcttgactaccggtaatgcctacccgctactttcgctcattttgaattaaggtcctttcgtcatgcaaatttggggaacatcaaagagacaaagacttagggaccactattttcttacagttcccctcatggtctgagaatatgctggga

SEQ ID NO: 427 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 428 - DNA, 469 bp, Artificial; identical to SEQ ID NO: 60
  TaSBEIIa-A allele with mutations introduced by TALEN pair TaSBEIIa_T01

SEQ ID NO: 429 - DNA, 459 bp, Artificial; identical to SEQ ID NO: 143
  TaSBEIIa-A allele with mutations introduced by TALEN pair TaSBEIIa_T01

SEQ ID NO: 430 - DNA, 464 bp, Artificial; identical to SEQ ID NO: 27
  TaSBEIIa-A allele with mutations introduced by TALEN pair TaSBEIIa_T01

SEQ ID NO: 431 - DNA, 464 bp, Artificial; identical to SEQ ID NO: 15
  TaSBEIIa-A allele with mutations introduced by TALEN pair TaSBEIIa_T01

SEQ ID NO: 432 - DNA, 445 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcaagaaaaacattgaatcattcaggaaaccgactcaaggcattgtggaaacaatcactgatggtgtaaccaaaggagttaaggaactagtcgtggggagaaaccgcgagttgtcccaaaaccaggagatggggcagaaaaatatgacagagattgaacccaatcgacgccatcttgactaccggtaatgccatcaacccggctacctttactgctccatttttgaaattaaaggtccttttcgcatgcaaatttggggaaacatcaaagagacaaagactagggaccactattttctt

SEQ ID NO: 433 - DNA, 464 bp, Artificial; identical to SEQ ID NO: 15
  TaSBEIIa-A allele with mutations introduced by TALEN pair TaSBEIIa_T01

SEQ ID NO: 434 - DNA, 469 bp, Artificial; identical to SEQ ID NO: 60
  TaSBEIIa-A allele with mutations introduced by TALEN pair TaSBEIIa_T01

SEQ ID NO: 435 - DNA, 464 bp, Artificial; identical to SEQ ID NO: 15
  TaSBEIIa-A allele with mutations introduced by TALEN pair TaSBEIIa_T01

SEQ ID NO: 436 - DNA, 457 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgaattttcggagccatcttgactaccggtaatgcctacccgctactttcgctcattttgaattaaggtcctttcgtcatgcaaatttggggaacatcaaagagacaaagactagggaccactatttcttacagttcccctcatggtctgag

SEQ ID NO: 437 - DNA, 556 bp, Artificial; identical to SEQ ID NO: 221
  TaSBEIIa-A allele with mutations introduced by TALEN pair TaSBEIIa_T01

SEQ ID NO: 438 - DNA, 463 bp, Artificial; identical to SEQ ID NO: 101
  TaSBEIIa-A allele with mutations introduced by TALEN pair TaSBEIIa_T01

SEQ ID NO: 439 - DNA, 464 bp, Artificial; identical to SEQ ID NO: 69
  TaSBEIIa-A allele with mutations introduced by TALEN pair TaSBEIIa_T01

SEQ ID NO: 440 - DNA, 467 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtccttcgtcatgcaaatttggggaacatcaaagagacaaagactagggaccactattttcttacagttcccctcatggtctgagaatatgctggga

SEQ ID NO: 441 - DNA, 464 bp, Artificial; identical to SEQ ID NO: 15
  TaSBEIIa-A allele with mutations introduced by TALEN pair TaSBEIIa_T01

SEQ ID NO: 442 - DNA, 466 bp, Artificial; identical to SEQ ID NO: 25
  TaSBEIIa-A allele with mutations introduced by TALEN pair TaSBEIIa_T01

SEQ ID NO: 443 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 444 - DNA, 482 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctgggactgagactccaagg

SEQ ID NO: 445 - DNA, 460 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctggga

SEQ ID NO: 446 - DNA, 459 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctatttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacattttcggagccatcttgactaccggtaatgcctacccgctactttcgctcattttgaaattaaggtcctttcgtcatgcaaatttggggaacatcaaagagacaaagactagggaccactattttcttacagttccccctcatggtctgagaatat

SEQ ID NO: 447 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctcacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 448 - DNA, 466 bp, Artificial; identical to SEQ ID NO: 80
  TaSBEIIa-A allele with mutations introduced by TALEN pair TaSBEIIa_T01

SEQ ID NO: 449 - DNA, 464 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttcggagccatcttgactaccggtaatgcctacccgctactttcgctcattttgaaattaaggtcctttcgtcatgcaaatttggggaacatcaaagagacaaagactagggaccactatttcttacagttcccctcatggtctgagaatatgctggga

SEQ ID NO: 450 - DNA, 466 bp, Artificial; identical to SEQ ID NO: 25
  TaSBEIIa-A allele with mutations introduced by TALEN pair TaSBEIIa_T01

SEQ ID NO: 451 - DNA, 470 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttttcggagccatcttgactaccggtaatgcctacccgctactttcgctcattttgaattaaggtcctttcgtcatgcaaatttggggaacatcaaagagacaaagactagggaccactattttcttacagtttccccctcatggtctgagaatatgctggga

SEQ ID NO: 452 - DNA, 463 bp, Artificial; identical to SEQ ID NO: 101
  TaSBEIIa-A allele with mutations introduced by TALEN pair TaSBEIIa_T01

SEQ ID NO: 453 - DNA, 467 bp, Artificial; identical to SEQ ID NO: 152
  TaSBEIIa-A allele with mutations introduced by TALEN pair TaSBEIIa_T01

SEQ ID NO: 454 - DNA, 464 bp, Artificial; identical to SEQ ID NO: 15
  TaSBEIIa-A allele with mutations introduced by TALEN pair TaSBEIIa_T01

SEQ ID NO: 455 - DNA, 467 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactaccggtaatgcctacccgctactttcgctcattttgaattaaggtcctttcatcatgcaaatttggggaacatcaaagagacaaagactagggaccaccatttcatacagatcccctcgtggtctgagaatatgctggga

SEQ ID NO: 456 - DNA, 463 bp, Artificial; identical to SEQ ID NO: 101
  TaSBEIIa-A allele with mutations introduced by TALEN pair TaSBEIIa_T01

SEQ ID NO: 457 - DNA, 458 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcagccatcttgactaccggtaatgcctacccgctacttcgctcattttgaattaaggtcctttcgcatgcaaatttggggaacatcaaagagacaaagactagggaccactattttcttacagttccccctcatggtctgagaatatgctggga

SEQ ID NO: 458 - DNA, 464 bp, Artificial; identical to SEQ ID NO: 15
  TaSBEIIa-A allele with mutations introduced by TALEN pair TaSBEIIa_T01

SEQ ID NO: 459 - DNA, 468 bp, Artificial; identical to SEQ ID NO: 248
  TaSBEIIa-A allele with mutations introduced by TALEN pair TaSBEIIa_T01

SEQ ID NO: 460 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactaccggtaatgcctacccgctactttcgctcattttgaattaaggtcctttcgtcatgcaaatttggggaacatcaaagagacaaaagactaggggaccactatttcttacagttccccctcatggtctgagaatatgct

SEQ ID NO: 461 - DNA, 466 bp, Artificial; identical to SEQ ID NO: 320
  TaSBEIIa-A allele with mutations introduced by TALEN pair TaSBEIIa_T01

SEQ ID NO: 462 - DNA, 464 bp, Artificial; identical to SEQ ID NO: 15
  TaSBEIIa-A allele with mutations introduced by TALEN pair TaSBEIIa_T01

SEQ ID NO: 463 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaaattaaggtcctttcgtcatgcaaatttggggaacatcaaagagacaaagactagggaccactatttcttacagttcccctcatggtctgagaatatgctggga

SEQ ID NO: 464 - DNA, 464 bp, Artificial; identical to SEQ ID NO: 15
  TaSBEIIa-A allele with mutations introduced by TALEN pair TaSBEIIa_T01

SEQ ID NO: 465 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcttgtggaaacaatcactgatggtgtaaccaaaggagttaaggaactagtcgtgggggagaaaccgcgagttgtcccaaaaccaggagatggggccgaaaaaatatacgagattgacccaatcgctgattcggagccatcttgactaccggtaatgcctacccgctactttcgctcattttgaattaaggtcctttcgtcatgcaaatttggggaacatcaaagagacaaagactaggggaccactatttcttacagttccccctcatggtctgagaatatgct

SEQ ID NO: 466 - DNA, 462 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 467 - DNA, 459 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgagccatcttgactaccggtaatgcctacccgctactttcgctcatttttgaattaaggtcctttcgcatgcaaatttggggaacatcaaagagacaaagactagggaccactattttcttacagttccccctcatggtctgagaatatgctggga

SEQ ID NO: 468 - DNA, 467 bp, Artificial; identical to SEQ ID NO: 37
  TaSBEIIa-A allele with mutations introduced by TALEN pair TaSBEIIa_T01

SEQ ID NO: 469 - DNA, 462 bp, Artificial; identical to SEQ ID NO: 67
  TaSBEIIa-A allele with mutations introduced by TALEN pair TaSBEIIa_T01

SEQ ID NO: 470 - DNA, 463 bp, Artificial; identical to SEQ ID NO: 101
  TaSBEIIa-A allele with mutations introduced by TALEN pair TaSBEIIa_T01

SEQ ID NO: 471 - DNA, 467 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttcggagccatcttgactaccggtaatgcctacccgctactttcgctcattttgaattaaggtcctttcgtcatgcaaatttggggaacatcaaagagacaaagacttaggggaccactattttcttacagttccccctcatggtctgagaatatgctggga

SEQ ID NO: 472 - DNA, 462 bp, Artificial; identical to SEQ ID NO: 67
  TaSBEIIa-A allele with mutations introduced by TALEN pair TaSBEIIa_T01

SEQ ID NO: 473 - DNA, 461 bp, Artificial; identical to SEQ ID NO: 192
  TaSBEIIa-A allele with mutations introduced by TALEN pair TaSBEIIa_T01

SEQ ID NO: 474 - DNA, 462 bp, Artificial; identical to SEQ ID NO: 67
  TaSBEIIa-A allele with mutations introduced by TALEN pair TaSBEIIa_T01

SEQ ID NO: 475 - DNA, 464 bp, Artificial; identical to SEQ ID NO: 15
  TaSBEIIa-A allele with mutations introduced by TALEN pair TaSBEIIa_T01

SEQ ID NO: 476 - DNA, 458 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaa

SEQ ID NO: 477 - DNA, 459 bp, Artificial; identical to SEQ ID NO: 143
  TaSBEIIa-A allele with mutations introduced by TALEN pair TaSBEIIa_T01

SEQ ID NO: 478 - DNA, 459 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatat

SEQ ID NO: 479 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatat

SEQ ID NO: 480 - DNA, 464 bp, Artificial; identical to SEQ ID NO: 15
  TaSBEIIa-A allele with mutations introduced by TALEN pair TaSBEIIa_T01

SEQ ID NO: 481 - DNA, 464 bp, Artificial; identical to SEQ ID NO: 69
  TaSBEIIa-A allele with mutations introduced by TALEN pair TaSBEIIa_T01

SEQ ID NO: 482 - DNA, 459 bp, Artificial; identical to SEQ ID NO: 143
  TaSBEIIa-A allele with mutations introduced by TALEN pair TaSBEIIa_T01

SEQ ID NO: 483 - DNA, 468 bp, Artificial; identical to SEQ ID NO: 23
  TaSBEIIa-A allele with mutations introduced by TALEN pair TaSBEIIa_T01

SEQ ID NO: 484 - DNA, 466 bp, Artificial; identical to SEQ ID NO: 177
  TaSBEIIa-A allele with mutations introduced by TALEN pair TaSBEIIa_T01

SEQ ID NO: 485 - DNA, 459 bp, Artificial; identical to SEQ ID NO: 143
  TaSBEIIa-A allele with mutations introduced by TALEN pair TaSBEIIa_T01

SEQ ID NO: 486 - DNA, 445 bp, Artificial; identical to SEQ ID NO: 105
  TaSBEIIa-A allele with mutations introduced by TALEN pair TaSBEIIa_T01

SEQ ID NO: 487 - DNA, 455 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttcccctcatggtctgag

SEQ ID NO: 488 - DNA, 459 bp, Artificial; identical to SEQ ID NO: 143
  TaSBEIIa-A allele with mutations introduced by TALEN pair TaSBEIIa_T01

SEQ ID NO: 489 - DNA, 459 bp, Artificial; identical to SEQ ID NO: 143
  TaSBEIIa-A allele with mutations introduced by TALEN pair TaSBEIIa_T01

SEQ ID NO: 490 - DNA, 462 bp, Artificial; identical to SEQ ID NO: 67
  TaSBEIIa-A allele with mutations introduced by TALEN pair TaSBEIIa_T01

SEQ ID NO: 491 - DNA, 465 bp, Artificial; identical to SEQ ID NO: 33
  TaSBEIIa-A allele with mutations introduced by TALEN pair TaSBEIIa_T01

SEQ ID NO: 492 - DNA, 462 bp, Artificial; identical to SEQ ID NO: 67
  TaSBEIIa-A allele with mutations introduced by TALEN pair TaSBEIIa_T01

SEQ ID NO: 493 - DNA, 464 bp, Artificial; identical to SEQ ID NO: 15
  TaSBEIIa-A allele with mutations introduced by TALEN pair TaSBEIIa_T01

SEQ ID NO: 494 - DNA, 433 bp, Artificial; identical to SEQ ID NO: 353
  TaSBEIIa-A allele with mutations introduced by TALEN pair TaSBEIIa_T01

SEQ ID NO: 495 - DNA, 463 bp, Artificial; identical to SEQ ID NO: 101
  TaSBEIIa-A allele with mutations introduced by TALEN pair TaSBEIIa_T01

SEQ ID NO: 496 - DNA, 518 bp, Artificial
  TaSBEIIa-A allele with mutations introduced by TALEN pair TaSBEIIa_T01
agatggatgtgcattctagcaagaacttcacgaaataatgcactgttttgtggttttcgtttagtctgctctacaattgctattttcgtgctgtagatacctgaagacatcgaggagcaaaacggctgaagtaaacatgacagggggacggtgcagaaaacttgactcaatctagaatcctgaacctcaggcattggtggaacgaatcatcctgatggtgtaaccaaaggagttaaggactagtcgtgggggagaaaccgcagagttgtcccaaaatccaaggagatggggcagaaaaagtatgagcagatgattgacccaatcgcctggcaaatggaaattttttcgggattgccgatccttcgtgctacctggatcgaaattggcccttaccccgctactttttccgctcatttttggaatttaaagggtccttttcgtcattgcaaaattttgggggaaacatcaaagaggacaaaagactagggggacccacctattttcttacagtttcccct

SEQ ID NO: 497 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattcggagccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgct

SEQ ID NO: 498 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctgga

SEQ ID NO: 499 - DNA, 462 bp, Artificial; identical to SEQ ID NO: 67
  TaSBEIIa-A allele with mutations introduced by TALEN pair TaSBEIIa_T01

SEQ ID NO: 500 - DNA, 464 bp, Artificial; identical to SEQ ID NO: 15
  TaSBEIIa-A allele with mutations introduced by TALEN pair TaSBEIIa_T01

SEQ ID NO: 501 - DNA, 458 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgatttcggagccatcttgactacccggtaatgcctacccgctacttttcgctcattttgaattaaggtcctttcgtcatgcaaatttggggaacatcaaagagacaaagactagggaccactatttcttacagttccccctcatggtctgag

SEQ ID NO: 502 - DNA, 467 bp, Artificial; identical to SEQ ID NO: 238
  TaSBEIIa-A allele with mutations introduced by TALEN pair TaSBEIIa_T01

SEQ ID NO: 503 - DNA, 464 bp, Artificial; identical to SEQ ID NO: 15
  TaSBEIIa-A allele with mutations introduced by TALEN pair TaSBEIIa_T01

SEQ ID NO: 504 - DNA, 428 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattcggagccatcttgactaccggtaatgcctacccgctactttcgctcattttgaattaaggtcctttcgtcatgcaaatttggggaacatcaaagagacaagactagggatccactatttcttacagttcccc

SEQ ID NO: 505 - DNA, 466 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctggga

SEQ ID NO: 506 - DNA, 466 bp, Artificial; identical to SEQ ID NO: 25
  TaSBEIIa-A allele with mutations introduced by TALEN pair TaSBEIIa_T01

SEQ ID NO: 507 - DNA, 464 bp, Artificial; identical to SEQ ID NO: 408
  TaSBEIIa-A allele with mutations introduced by TALEN pair TaSBEIIa_T01

SEQ ID NO: 508 - DNA, 459 bp, Artificial; identical to SEQ ID NO: 143
  TaSBEIIa-A allele with mutations introduced by TALEN pair TaSBEIIa_T01

SEQ ID NO: 509 - DNA, 469 bp, Artificial; identical to SEQ ID NO: 60
  TaSBEIIa-A allele with mutations introduced by TALEN pair TaSBEIIa_T01

SEQ ID NO: 510 - DNA, 471 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggggagaaaccgcgagttgtcccaaaaccaggagatggggcgaaaaatatacgagattgacccaacgctgattttcggagccatcttgactaccggtaatgcctacccgctactttcgctcattttgaattaaggtcctttcgtcatgcaaatttgggggaacatcaaagagacaaagactaggggaccactattttcttacagttcccctcatggtctgagaatatgctggg

SEQ ID NO: 511 - DNA, 465 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 512 - DNA, 468 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattttcggagccatcttgactaccggtaatgcctacccgctactttcgctcattttgaattaaggtcctttcgtcatgcaaatttgggggaacatcaaagagacaaagactaggggaccactatttcttacagttccccctcatggtctgagaatatgct

SEQ ID NO: 513 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 514 - DNA, 463 bp, Artificial
  TaSBEIIa-A allele with mutations introduced by TALEN pair TaSBEIIa_T01
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggggcagaaaaatatacgagattgacccaacgctgattcggagccatcttgactaccggtaatgcctacccgctactttcgctcattttgaattaaggtcctttcgtcatgcaaatttggggaacatcaaagagacaaagactagggaccactatttcttacagttccccctcatggtctgagaatatgct

SEQ ID NO: 515 - DNA, 465 bp, Artificial; identical to SEQ ID NO: 33
  TaSBEIIa-A allele with mutations introduced by TALEN pair TaSBEIIa_T01

SEQ ID NO: 516 - DNA, 465 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 517 - DNA, 460 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaccaggagatgggcagaaaatatacgagattgacccaacgttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 518 - DNA, 456 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccagagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 519 - DNA, 454 bp, Artificial
  TaSBEIIa-B allele with mutations introduced by TALEN pair TaSBEIIa_T01
agatggatgtgcattctagcaagaacttcacaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaaggagatgggcagaaaataatacgagattgacccaacgttttcggagccatcttgactaccggtaatgcctacccgctaatttcgctcattttgaattaaggtcctttcatcatgcaaatttggggaacatcaaagaggcaaagactagggaccactatttcatacagttccccttcatggtctgag

SEQ ID NO: 520 - DNA, 463 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaaggagatgggcagaaaataatacgagattgacccaacgctattttcggagccatcttgactaccggtaatgcctaccgctaattcgctcattttgaattaaggtcctttcatcatgcaaatttggggaacatcaaagaggcaaagactagggaccactatttcatacagttcccctcatggtctgagaatatgct

SEQ ID NO: 521 - DNA, 465 bp, Artificial; identical to SEQ ID NO: 516
  TaSBEIIa-B allele with mutations introduced by TALEN pair TaSBEIIa_T01

SEQ ID NO: 522 - DNA, 457 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgag

SEQ ID NO: 523 - DNA, 465 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 524 - DNA, 458 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggg

SEQ ID NO: 525 - DNA, 464 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaaggagatgggcagaaaatatacgagattgacccaacgctattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 526 - DNA, 465 bp, Artificial; identical to SEQ ID NO: 523
  TaSBEIIa-B allele with mutations introduced by TALEN pair TaSBEIIa_T01

SEQ ID NO: 527 - DNA, 463 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 528 - DNA, 405 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaaggagatgggcagaaaataatacgagattgacccaacgctgattttcggagccatcttgactaccggtaatgcctacccgctaatttcgctcattttgaattcaaggtcctttcatcatgcaaatttggggaacatc

SEQ ID NO: 529 - DNA, 458 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgttttcggagccatcttgactaccggtaatgcctacccgctaatttcgctcattttgaattaaggtccttcatcatgcaaatttggggaacatcaaagaggcaaagactagggaccactatttcatacagttccccttcatggtctgagcaata

SEQ ID NO: 530 - DNA, 465 bp, Artificial; identical to SEQ ID NO: 516
  TaSBEIIa-B allele with mutations introduced by TALEN pair TaSBEIIa_T01

SEQ ID NO: 531 - DNA, 465 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgttttcggagccatcttgactaccggtaatgcctacccgctaatttcgctcattttgaaattaaggtcctttcatcatgcaaatttggggaacatcaaagaggcaaagactagggaccactatttcatacagttcccctcatggtctgagaatatgctggga

SEQ ID NO: 532 - DNA, 457 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaaggagatgggcagaaaataatacgagattgacccaacgctgattttcggagccatcttgactaccggtaatgcctacccgctaatttcgctcattttgaattaaggtcctttcatcatgcaaatttggggaacatcaaagaggcaaagagctagggaccagctaatttcatcaggttcccctcattgtc

SEQ ID NO: 533 - DNA, 465 bp, Artificial; identical to SEQ ID NO: 523
  TaSBEIIa-B allele with mutations introduced by TALEN pair TaSBEIIa_T01

SEQ ID NO: 534 - DNA, 466 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgaattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 535 - DNA, 463 bp, Artificial; identical to SEQ ID NO: 527
  TaSBEIIa-B allele with mutations introduced by TALEN pair TaSBEIIa_T01

SEQ ID NO: 536 - DNA, 464 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 537 - DNA, 465 bp, Artificial; identical to SEQ ID NO: 516
  TaSBEIIa-B allele with mutations introduced by TALEN pair TaSBEIIa_T01

SEQ ID NO: 538 - DNA, 466 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgttttcggagccatcttgactaccggtaatgcctacccgctaatttcgctcattttgaaattaaggtcctttcatcatgcaaatttggggaacatcaaagaggcaaagactagggaccactatttcatacagttcccctcatggtctgagaatatgctggga

SEQ ID NO: 539 - DNA, 465 bp, Artificial; identical to SEQ ID NO: 516
  TaSBEIIa-B allele with mutations introduced by TALEN pair TaSBEIIa_T01

SEQ ID NO: 540 - DNA, 464 bp, Artificial; identical to SEQ ID NO: 536
  TaSBEIIa-B allele with mutations introduced by TALEN pair TaSBEIIa_T01

SEQ ID NO: 541 - DNA, 440 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgaattttcggagccatcttgactaccggtaatgcctacccgctaatttcgctcattttgaattaaggtcctttcatcatgcaaatttggggaacatcaaagaggcaaagactagggaccactatttcatacagt

SEQ ID NO: 542 - DNA, 464 bp, Artificial; identical to SEQ ID NO: 536
  TaSBEIIa-B allele with mutations introduced by TALEN pair TaSBEIIa_T01

SEQ ID NO: 543 - DNA, 464 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggcgtaaccaaaggagttaaggaactagtcgcggggagaaaccgcgagttgtcccaaaaccaggagatgggcagaaaatatacgagattgacccaacgctattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 544 - DNA, 450 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 545 - DNA, 464 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 546 - DNA, 465 bp, Artificial; identical to SEQ ID NO: 516
  TaSBEIIa-B allele with mutations introduced by TALEN pair TaSBEIIa_T01

SEQ ID NO: 547 - DNA, 467 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaaccaggagatgggcagaaaatatacgagattgacccaacgttttcggagccatcttgactaccggtaatgcctacccgctaatttcgctcattttgaaattaaggtcctttcatcatgcaaatttggggaacatcaaagaggcaaagactagggaccactatttcatacagttcccctcatggtctgagaatatgctggga

SEQ ID NO: 548 - DNA, 460 bp, Artificial
  TaSBEIIa-B allele with mutations introduced by TALEN pair TaSBEIIa_T01
  misc_feature (439): n is a or c or t or g
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagagctagggaccagctaatttcatncaggttcccctcattgtctga

SEQ ID NO: 549 - DNA, 463 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 550 - DNA, 465 bp, Artificial; identical to SEQ ID NO: 523
  TaSBEIIa-B allele with mutations introduced by TALEN pair TaSBEIIa_T01

SEQ ID NO: 551 - DNA, 464 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgatttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 552 - DNA, 465 bp, Artificial; identical to SEQ ID NO: 516
  TaSBEIIa-B allele with mutations introduced by TALEN pair TaSBEIIa_T01

SEQ ID NO: 553 - DNA, 464 bp, Artificial; identical to SEQ ID NO: 536
  TaSBEIIa-B allele with mutations introduced by TALEN pair TaSBEIIa_T01

SEQ ID NO: 554 - DNA, 464 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaccaggagatgggcagaaaatatacgagattgacccaacgttttcggagccatcttgactaccggtaatgcctacccgctaatttcgctcattttgaaattaaggtcctttcatcatgcaaatttggggaacatcaaagaggcaaagactagggaccactatttcatacagttcccctcatggtctgagaatatgctggga

SEQ ID NO: 555 - DNA, 465 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgaattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 556 - DNA, 472 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccagctaatttcatcaggttcccctcattgtctgagaattcatgctggga

SEQ ID NO: 557 - DNA, 464 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaaccaggagatgggcagaaaaatatacgagattgacccaacgctattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatct

SEQ ID NO: 558 - DNA, 462 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgcttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 559 - DNA, 460 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaat

SEQ ID NO: 560 - DNA, 465 bp, Artificial; identical to SEQ ID NO: 516
  TaSBEIIa-B allele with mutations introduced by TALEN pair TaSBEIIa_T01

SEQ ID NO: 561 - DNA, 450 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaaggagatgggcagaaaatatacgagattggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 562 - DNA, 463 bp, Artificial; identical to SEQ ID NO: 549
  TaSBEIIa-B allele with mutations introduced by TALEN pair TaSBEIIa_T01

SEQ ID NO: 563 - DNA, 465 bp, Artificial; identical to SEQ ID NO: 555
  TaSBEIIa-B allele with mutations introduced by TALEN pair TaSBEIIa_T01

SEQ ID NO: 564 - DNA, 451 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 565 - DNA, 465 bp, Artificial; identical to SEQ ID NO: 555
  TaSBEIIa-B allele with mutations introduced by TALEN pair TaSBEIIa_T01

SEQ ID NO: 566 - DNA, 464 bp, Artificial; identical to SEQ ID NO: 536
  TaSBEIIa-B allele with mutations introduced by TALEN pair TaSBEIIa_T01

SEQ ID NO: 567 - DNA, 464 bp, Artificial; identical to SEQ ID NO: 536
  TaSBEIIa-B allele with mutations introduced by TALEN pair TaSBEIIa_T01

SEQ ID NO: 568 - DNA, 464 bp, Artificial; identical to SEQ ID NO: 536
  TaSBEIIa-B allele with mutations introduced by TALEN pair TaSBEIIa_T01

SEQ ID NO: 569 - DNA, 464 bp, Artificial; identical to SEQ ID NO: 551
  TaSBEIIa-B allele with mutations introduced by TALEN pair TaSBEIIa_T01

SEQ ID NO: 570 - DNA, 465 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaaggagatgggcagaaaatatacgagattgacccaacgctattttcggagccatcttgactaccggtaatgcctacccgctaatttcgctcattttgaattaaggtcctttcatcatgcaaatttggggaacatcaaagaggcaaagactagggaccactattttcatacagttcccctcatggtctgagaatatgct

SEQ ID NO: 571 - DNA, 466 bp, Artificial; identical to SEQ ID NO: 534
  TaSBEIIa-B allele with mutations introduced by TALEN pair TaSBEIIa_T01

SEQ ID NO: 572 - DNA, 475 bp, Artificial
  TaSBEIIa-B allele with mutations introduced by TALEN pair TaSBEIIa_T01
  misc_feature (439): n is a or c or t or g
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaaccagctaatttcatncaggttcccctcattgtctgagaattcatgctggga

SEQ ID NO: 573 - DNA, 461 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgttttcggagccatcttgactaccggtaatgcctacccgctaatttcgctcattttgaaattaaggtcctttcatcatgcaaatttggggaacatcaaagaggcaaagactagggaccactatttcatacagttcccctcatggtctgagaatatgct

SEQ ID NO: 574 - DNA, 464 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaaatatacgagattgacccaacgctattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgc

SEQ ID NO: 575 - DNA, 463 bp, Artificial; identical to SEQ ID NO: 527
  TaSBEIIa-B allele with mutations introduced by TALEN pair TaSBEIIa_T01

SEQ ID NO: 576 - DNA, 459 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgccatcttgactaccggtaatgcctacccgctaatttcgctcattttgaaattaaggtcctttcatcatgcaaatttggggaacatcaaagaggcaaagactagggaccactatttcatacagttcccctcatggtctgagaatatgctggga

SEQ ID NO: 577 - DNA, 458 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 578 - DNA, 465 bp, Artificial; identical to SEQ ID NO: 516
  TaSBEIIa-B allele with mutations introduced by TALEN pair TaSBEIIa_T01

SEQ ID NO: 579 - DNA, 465 bp, Artificial; identical to SEQ ID NO: 516
  TaSBEIIa-B allele with mutations introduced by TALEN pair TaSBEIIa_T01

SEQ ID NO: 580 - DNA, 465 bp, Artificial; identical to SEQ ID NO: 523
  TaSBEIIa-B allele with mutations introduced by TALEN pair TaSBEIIa_T01

SEQ ID NO: 581 - DNA, 459 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 582 - DNA, 466 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgct

SEQ ID NO: 583 - DNA, 465 bp, Artificial; identical to SEQ ID NO: 516
  TaSBEIIa-B allele with mutations introduced by TALEN pair TaSBEIIa_T01

SEQ ID NO: 584 - DNA, 465 bp, Artificial; identical to SEQ ID NO: 516
  TaSBEIIa-B allele with mutations introduced by TALEN pair TaSBEIIa_T01

SEQ ID NO: 585 - DNA, 465 bp, Artificial; identical to SEQ ID NO: 523
  TaSBEIIa-B allele with mutations introduced by TALEN pair TaSBEIIa_T01

SEQ ID NO: 586 - DNA, 465 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgttttcggagccatcttgactaccggtaatgcctacccgctaatttcgctcattttgaaattaaggtcctttcatcatgcaaatttggggaacatcaaagaggcaaagactagggaccactatttcatacagttcccctcatggtctgagaatatgctggg

SEQ ID NO: 587 - DNA, 466 bp, Artificial; identical to SEQ ID NO: 538
  TaSBEIIa-B allele with mutations introduced by TALEN pair TaSBEIIa_T01

SEQ ID NO: 588 - DNA, 450 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgaccgccatcttgactaccggtaatgcctacccgctaatttcgctcatttgaattaaggtcctttcatcatgcaaatttggggaacatcaaagaggcaaagactagggaccactatttcatacagttcccctcatggtctgagaatatgctggga

SEQ ID NO: 589 - DNA, 462 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 590 - DNA, 461 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 591 - DNA, 406 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaa

SEQ ID NO: 592 - DNA, 451 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgaccgccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 593 - DNA, 465 bp, Artificial; identical to SEQ ID NO: 516
  TaSBEIIa-B allele with mutations introduced by TALEN pair TaSBEIIa_T01

SEQ ID NO: 594 - DNA, 462 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaaatatacgagattgacccaacattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 595 - DNA, 465 bp, Artificial
  TaSBEIIa-B allele with mutations introduced by TALEN pair TaSBEIIa_T01
agatggatgtgcattctagcaagaacttcaacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgatttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 596 - DNA, 464 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 597 - DNA, 460 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgccatcttgactaccggtaatgcctacccgctaatttcgctcattttgaaattaaggtcctttcatcatgcaaatttggggaacatcaaagaggcaaagactagggaccactatttcatacagttcccctcatggtctgagaatatgctggga

SEQ ID NO: 598 - DNA, 464 bp, Artificial; identical to SEQ ID NO: 596
  TaSBEIIa-B allele with mutations introduced by TALEN pair TaSBEIIa_T01

SEQ ID NO: 599 - DNA, 465 bp, Artificial; identical to SEQ ID NO: 516
  TaSBEIIa-B allele with mutations introduced by TALEN pair TaSBEIIa_T01

SEQ ID NO: 600 - DNA, 464 bp, Artificial; identical to SEQ ID NO: 536
  TaSBEIIa-B allele with mutations introduced by TALEN pair TaSBEIIa_T01

SEQ ID NO: 601 - DNA, 466 bp, Artificial; identical to SEQ ID NO: 582
  TaSBEIIa-B allele with mutations introduced by TALEN pair TaSBEIIa_T01

SEQ ID NO: 602 - DNA, 458 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 603 - DNA, 464 bp, Artificial; identical to SEQ ID NO: 596
  TaSBEIIa-B allele with mutations introduced by TALEN pair TaSBEIIa_T01

SEQ ID NO: 604 - DNA, 466 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 605 - DNA, 465 bp, Artificial; identical to SEQ ID NO: 516
  TaSBEIIa-B allele with mutations introduced by TALEN pair TaSBEIIa_T01

SEQ ID NO: 606 - DNA, 456 bp, Artificial; identical to SEQ ID NO: 518
  TaSBEIIa-B allele with mutations introduced by TALEN pair TaSBEIIa_T01

SEQ ID NO: 607 - DNA, 436 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgttttcggagccatcttgactaccggtaatgcctacccgctaatttcgctcattttgaattaaggtcctttcatcatgcaaatttggggaacatcaaagaggcaaagactagggaccactattttcatacag

SEQ ID NO: 608 - DNA, 464 bp, Artificial; identical to SEQ ID NO: 596
  TaSBEIIa-B allele with mutations introduced by TALEN pair TaSBEIIa_T01

SEQ ID NO: 609 - DNA, 464 bp, Artificial; identical to SEQ ID NO: 596
  TaSBEIIa-B allele with mutations introduced by TALEN pair TaSBEIIa_T01

SEQ ID NO: 610 - DNA, 459 bp, Artificial; identical to SEQ ID NO: 581
  TaSBEIIa-B allele with mutations introduced by TALEN pair TaSBEIIa_T01

SEQ ID NO: 611 - DNA, 464 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaaggagatgggcagaaaataatacgagattgacccagagccatcttgactaccggtaatgcctacccgctaatttcgctcattttgaattaaggtcctttcatcatgcaaatttggggaacagtctaaagaggcaaagacgtaggaccactatttcatacaggttccccattcatggtctggagcaatattgtggga

SEQ ID NO: 612 - DNA, 464 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaccaggagatgggcagaaaatatacgagattgacccaacgttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 613 - DNA, 466 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttccccctcatggtctgagaatatgct

SEQ ID NO: 614 - DNA, 463 bp, Artificial; identical to SEQ ID NO: 527
  TaSBEIIa-B allele with mutations introduced by TALEN pair TaSBEIIa_T01

SEQ ID NO: 615 - DNA, 465 bp, Artificial; identical to SEQ ID NO: 516
  TaSBEIIa-B allele with mutations introduced by TALEN pair TaSBEIIa_T01

SEQ ID NO: 616 - DNA, 464 bp, Artificial; identical to SEQ ID NO: 551
  TaSBEIIa-B allele with mutations introduced by TALEN pair TaSBEIIa_T01

SEQ ID NO: 617 - DNA, 464 bp, Artificial; identical to SEQ ID NO: 545
  TaSBEIIa-B allele with mutations introduced by TALEN pair TaSBEIIa_T01

SEQ ID NO: 618 - DNA, 466 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 619 - DNA, 465 bp, Artificial; identical to SEQ ID NO: 516
  TaSBEIIa-B allele with mutations introduced by TALEN pair TaSBEIIa_T01

SEQ ID NO: 620 - DNA, 464 bp, Artificial; identical to SEQ ID NO: 596
  TaSBEIIa-B allele with mutations introduced by TALEN pair TaSBEIIa_T01

SEQ ID NO: 621 - DNA, 465 bp, Artificial; identical to SEQ ID NO: 516
  TaSBEIIa-B allele with mutations introduced by TALEN pair TaSBEIIa_T01

SEQ ID NO: 622 - DNA, 466 bp, Artificial; identical to SEQ ID NO: 618
  TaSBEIIa-B allele with mutations introduced by TALEN pair TaSBEIIa_T01

SEQ ID NO: 623 - DNA, 464 bp, Artificial; identical to SEQ ID NO: 536
  TaSBEIIa-B allele with mutations introduced by TALEN pair TaSBEIIa_T01

SEQ ID NO: 624 - DNA, 464 bp, Artificial; identical to SEQ ID NO: 536
  TaSBEIIa-B allele with mutations introduced by TALEN pair TaSBEIIa_T01

SEQ ID NO: 625 - DNA, 456 bp, Artificial; identical to SEQ ID NO: 518
  TaSBEIIa-B allele with mutations introduced by TALEN pair TaSBEIIa_T01

SEQ ID NO: 626 - DNA, 464 bp, Artificial; identical to SEQ ID NO: 536
  TaSBEIIa-B allele with mutations introduced by TALEN pair TaSBEIIa_T01

SEQ ID NO: 627 - DNA, 464 bp, Artificial; identical to SEQ ID NO: 536
  TaSBEIIa-B allele with mutations introduced by TALEN pair TaSBEIIa_T01

SEQ ID NO: 628 - DNA, 462 bp, Artificial; identical to SEQ ID NO: 589
  TaSBEIIa-B allele with mutations introduced by TALEN pair TaSBEIIa_T01

SEQ ID NO: 629 - DNA, 463 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgatttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 630 - DNA, 464 bp, Artificial; identical to SEQ ID NO: 596
  TaSBEIIa-B allele with mutations introduced by TALEN pair TaSBEIIa_T01

SEQ ID NO: 631 - DNA, 465 bp, Artificial; identical to SEQ ID NO: 516
  TaSBEIIa-B allele with mutations introduced by TALEN pair TaSBEIIa_T01

SEQ ID NO: 632 - DNA, 459 bp, Artificial; identical to SEQ ID NO: 581
  TaSBEIIa-B allele with mutations introduced by TALEN pair TaSBEIIa_T01

SEQ ID NO: 633 - DNA, 465 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctattttcggagccatcttgactaccggtaatgcctacccgctaatttcgctcattttgaattaaggtcctttcatcatgcaaatttggggaacatcaaagaggcaaagactagggaccactatttcatacagttcccctcatggctctgagaatatgct

SEQ ID NO: 634 - DNA, 465 bp, Artificial; identical to SEQ ID NO: 516
  TaSBEIIa-B allele with mutations introduced by TALEN pair TaSBEIIa_T01

SEQ ID NO: 635 - DNA, 464 bp, Artificial; identical to SEQ ID NO: 596
  TaSBEIIa-B allele with mutations introduced by TALEN pair TaSBEIIa_T01

SEQ ID NO: 636 - DNA, 456 bp, Artificial; identical to SEQ ID NO: 518
  TaSBEIIa-B allele with mutations introduced by TALEN pair TaSBEIIa_T01

SEQ ID NO: 637 - DNA, 456 bp, Artificial; identical to SEQ ID NO: 518
  TaSBEIIa-B allele with mutations introduced by TALEN pair TaSBEIIa_T01

SEQ ID NO: 638 - DNA, 465 bp, Artificial; identical to SEQ ID NO: 523
  TaSBEIIa-B allele with mutations introduced by TALEN pair TaSBEIIa_T01

SEQ ID NO: 639 - DNA, 466 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaaccaggagatgggcagaaaaatatacgagattgacccaacgctattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 640 - DNA, 464 bp, Artificial; identical to SEQ ID NO: 596
  TaSBEIIa-B allele with mutations introduced by TALEN pair TaSBEIIa_T01

SEQ ID NO: 641 - DNA, 463 bp, Artificial; identical to SEQ ID NO: 527
  TaSBEIIa-B allele with mutations introduced by TALEN pair TaSBEIIa_T01

SEQ ID NO: 642 - DNA, 457 bp, Artificial; identical to SEQ ID NO: 522
  TaSBEIIa-B allele with mutations introduced by TALEN pair TaSBEIIa_T01

SEQ ID NO: 643 - DNA, 465 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 644 - DNA, 464 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctattttcggagccatcttgactaccggtaatgcctacccgctaatttcgctcattttgaattaaggtccttcatcatgcaaatttggggaacatcaaagaggcaaagactagggacccactatttcatacagttcccctcatggtctgagaatatgct

SEQ ID NO: 645 - DNA, 465 bp, Artificial; identical to SEQ ID NO: 516
  TaSBEIIa-B allele with mutations introduced by TALEN pair TaSBEIIa_T01

SEQ ID NO: 646 - DNA, 463 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgc

SEQ ID NO: 647 - DNA, 451 bp, Artificial; identical to SEQ ID NO: 564
  TaSBEIIa-B allele with mutations introduced by TALEN pair TaSBEIIa_T01

SEQ ID NO: 648 - DNA, 466 bp, Artificial; identical to SEQ ID NO: 604
  TaSBEIIa-B allele with mutations introduced by TALEN pair TaSBEIIa_T01

SEQ ID NO: 649 - DNA, 465 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 650 - DNA, 464 bp, Artificial; identical to SEQ ID NO: 536
  TaSBEIIa-B allele with mutations introduced by TALEN pair TaSBEIIa_T01

SEQ ID NO: 651 - DNA, 451 bp, Artificial; identical to SEQ ID NO: 564
  TaSBEIIa-B allele with mutations introduced by TALEN pair TaSBEIIa_T01

SEQ ID NO: 652 - DNA, 466 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgttttcggagccatcttgactaccggtaatgcctacccgctaatttcgctcattttgaattaaggtcctttcatcatgcaaatttggggaacatcaaagaggcaaagactagggaccactattttcatacagttcccctcatggtctgagaatatgctggga

SEQ ID NO: 653 - DNA, 464 bp, Artificial; identical to SEQ ID NO: 536
  TaSBEIIa-B allele with mutations introduced by TALEN pair TaSBEIIa_T01

SEQ ID NO: 654 - DNA, 463 bp, Artificial; identical to SEQ ID NO: 527
  TaSBEIIa-B allele with mutations introduced by TALEN pair TaSBEIIa_T01

SEQ ID NO: 655 - DNA, 464 bp, Artificial; identical to SEQ ID NO: 551
  TaSBEIIa-B allele with mutations introduced by TALEN pair TaSBEIIa_T01

SEQ ID NO: 656 - DNA, 465 bp, Artificial; identical to SEQ ID NO: 516
  TaSBEIIa-B allele with mutations introduced by TALEN pair TaSBEIIa_T01

SEQ ID NO: 657 - DNA, 450 bp, Artificial; identical to SEQ ID NO: 544
  TaSBEIIa-B allele with mutations introduced by TALEN pair TaSBEIIa_T01

SEQ ID NO: 658 - DNA, 463 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 659 - DNA, 451 bp, Artificial; identical to SEQ ID NO: 592
  TaSBEIIa-B allele with mutations introduced by TALEN pair TaSBEIIa_T01

SEQ ID NO: 660 - DNA, 460 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccttcggagccatcttgactaccggtaatgcctacccgctaatttcgctcattttgaaattaaggtcctttcatcatgcaaatttggggaacatcaaagaggcaaagactagggaccactatttcatacagttcccctcatggtctgagaatatgctggga

SEQ ID NO: 661 - DNA, 464 bp, Artificial; identical to SEQ ID NO: 536
  TaSBEIIa-B allele with mutations introduced by TALEN pair TaSBEIIa_T01

SEQ ID NO: 662 - DNA, 464 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggg

SEQ ID NO: 663 - DNA, 465 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaaccaggagatgggcagaaaatatacgagattgacccaacgctattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 664 - DNA, 467 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgtttttcggagccatctttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 665 - DNA, 472 bp, Artificial
  TaSBEIIa-B allele with mutations introduced by TALEN pair TaSBEIIa_T01
  misc_feature (440): n is a or c or t or g
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaataatacgagattgacccaacgctgaattttcggagccatcttgactaccggtaatgcctacccgctaatttcgctcattttgaattaaggtcctttcatcatgcaaatttggggaacatcaaagaggcaaagactagggaccaactaatttcatncaggttcccctcattgtctgagaattcatgct

SEQ ID NO: 666 - DNA, 463 bp, Artificial; identical to SEQ ID NO: 527
  TaSBEIIa-B allele with mutations introduced by TALEN pair TaSBEIIa_T01

SEQ ID NO: 667 - DNA, 467 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaaccaggagatgggcagaaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 668 - DNA, 465 bp, Artificial; identical to SEQ ID NO: 516
  TaSBEIIa-B allele with mutations introduced by TALEN pair TaSBEIIa_T01

SEQ ID NO: 669 - DNA, 465 bp, Artificial; identical to SEQ ID NO: 555
  TaSBEIIa-B allele with mutations introduced by TALEN pair TaSBEIIa_T01

SEQ ID NO: 670 - DNA, 458 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgag

SEQ ID NO: 671 - DNA, 452 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgaccgccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 672 - DNA, 464 bp, Artificial; identical to SEQ ID NO: 536
  TaSBEIIa-B allele with mutations introduced by TALEN pair TaSBEIIa_T01

SEQ ID NO: 673 - DNA, 464 bp, Artificial; identical to SEQ ID NO: 536
  TaSBEIIa-B allele with mutations introduced by TALEN pair TaSBEIIa_T01

SEQ ID NO: 674 - DNA, 463 bp, Artificial
  TaSBEIIa-B allele with mutations introduced by TALEN pair TaSBEIIa_T01
  misc_feature (177); (182): n is a or c or t or g
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccnactcngggcattgtggaaacaatcactgatggtgtaaccaaaggagttaaggaactagtcgcggggagaaaccgcgagttgtcccaaaaccaggagatgggcagaaaatatacgagattgacccaacgctattttcggagccatcttgactaccggtaatgcctacccgctaattcgctcattttgaattaaggtcctttcatcatgcaaatttggggaacatcaaagaggcaaagactagggaccactatttcatacagttcccctcatggtctgagaatatgct

SEQ ID NO: 675 - DNA, 472 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggcgtgaagatgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaagccaggaagatgggcagaaaatatacgagcattgacccaacgctgaatttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 676 - DNA, 464 bp, Artificial
  TaSBEIIa-B allele with mutations introduced by TALEN pair TaSBEIIa_T01
agatggatgtgcattctagcaagaattcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 677 - DNA, 464 bp, Artificial; identical to SEQ ID NO: 536
  TaSBEIIa-B allele with mutations introduced by TALEN pair TaSBEIIa_T01

SEQ ID NO: 678 - DNA, 464 bp, Artificial; identical to SEQ ID NO: 536
  TaSBEIIa-B allele with mutations introduced by TALEN pair TaSBEIIa_T01

SEQ ID NO: 679 - DNA, 465 bp, Artificial; identical to SEQ ID NO: 523
  TaSBEIIa-B allele with mutations introduced by TALEN pair TaSBEIIa_T01

SEQ ID NO: 680 - DNA, 469 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaaccaggagatgggcagaaaatatacgagattgacccaacgttttcggagccatcttgactaccggtaatgcctacccgctaatttcgctcattttgaaattaaggtcctttcatcatgcaaatttggggaacatcaaaagaggcaaagactaggggaccactatttcatacagttcccctcatggtctgagaatatgctggga

SEQ ID NO: 681 - DNA, 464 bp, Artificial; identical to SEQ ID NO: 536
  TaSBEIIa-B allele with mutations introduced by TALEN pair TaSBEIIa_T01

SEQ ID NO: 682 - DNA, 465 bp, Artificial; identical to SEQ ID NO: 516
  TaSBEIIa-B allele with mutations introduced by TALEN pair TaSBEIIa_T01

SEQ ID NO: 683 - DNA, 458 bp, Artificial; identical to SEQ ID NO: 602
  TaSBEIIa-B allele with mutations introduced by TALEN pair TaSBEIIa_T01

SEQ ID NO: 684 - DNA, 464 bp, Artificial; identical to SEQ ID NO: 536
  TaSBEIIa-B allele with mutations introduced by TALEN pair TaSBEIIa_T01

SEQ ID NO: 685 - DNA, 456 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaaccaggagatgggcagaaaatatacgagattgacccagagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 686 - DNA, 464 bp, Artificial; identical to SEQ ID NO: 536
  TaSBEIIa-B allele with mutations introduced by TALEN pair TaSBEIIa_T01

SEQ ID NO: 687 - DNA, 451 bp, Artificial; identical to SEQ ID NO: 564
  TaSBEIIa-B allele with mutations introduced by TALEN pair TaSBEIIa_T01

SEQ ID NO: 688 - DNA, 460 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaattttggggaacatcaaagaggcaaagactagggaccactatttcatacagttcccctcatggtctgagaat

SEQ ID NO: 689 - DNA, 461 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaaatatacgagattgacccaacgctgccatcttgactaccggtaatgcctacccgctaatttcgctcattttgaaattaaggtcctttcatcatgcaaatttggggaacatcaaagaggcaaagactagggaccactatttcatacagttcccctcatggtctgagaatatgctggga

SEQ ID NO: 690 - DNA, 467 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaaatatacgagattgacccaacgttttcggagccatcttgactaccggtaatgcctacccgctaatttcgctcattttgaaattaaggtcctttcatcatgcaaatttggggaacatcaaagaggcaaagactagggaccactatttcatacagttcccctcatggtctgagaatatgctggga

SEQ ID NO: 691 - DNA, 460 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 692 - DNA, 466 bp, Artificial; identical to SEQ ID NO: 534
  TaSBEIIa-B allele with mutations introduced by TALEN pair TaSBEIIa_T01

SEQ ID NO: 693 - DNA, 464 bp, Artificial; identical to SEQ ID NO: 536
  TaSBEIIa-B allele with mutations introduced by TALEN pair TaSBEIIa_T01

SEQ ID NO: 694 - DNA, 464 bp, Artificial; identical to SEQ ID NO: 536
  TaSBEIIa-B allele with mutations introduced by TALEN pair TaSBEIIa_T01

SEQ ID NO: 695 - DNA, 468 bp, Artificial
  TaSBEIIa-B allele with mutations introduced by TALEN pair TaSBEIIa_T01
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaaccaggagatgggcagaaaaatatacgagattgacccaacgctgattttcggagccatcttgactaccggtaatgcctacccgctaaatttcgctcattttgaattaaggtcctttcatcatgcaaatttggggaacatcaaagaggcaaagactagggaccactatttcatacagttcccctcatggtctgagaatatgct

SEQ ID NO: 696 - DNA, 523 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaagccgcgagttgtcccaaaaccaggagatgggcagaaaatatacgagattgacccaacactggcgggtgtcggggctggcttaactatgcggcatcagagcagattgtactgagagtgcaccatttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgct

SEQ ID NO: 697 - DNA, 465 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 698 - DNA, 468 bp, Artificial
  TaSBEIIa-D allele with mutations introduced by TALEN pair TaSBEIIa_T01
agatggatgtgcattctagcaagaacttcacaacataatgcaccgtttggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacgattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 699 - DNA, 467 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 700 - DNA, 466 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttcggagccatcttgactaccggtaatgcctacccgctgctttcgctcattttgaattaaggtcctttcatcatgcaaatttggggaacatcaaagagacaaagactagggaccaccattttcatacagatcccctcgtggtcctgagaatatgctggga

SEQ ID NO: 701 - DNA, 465 bp, Artificial; identical to SEQ ID NO: 697
  TaSBEIIa-D allele with mutations introduced by TALEN pair TaSBEIIa_T01

SEQ ID NO: 702 - DNA, 465 bp, Artificial
  TaSBEIIa-D allele with mutations introduced by TALEN pair TaSBEIIa_T01
agatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 703 - DNA, 469 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaacttcatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 704 - DNA, 472 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattttcatacagatcccctcgtggtcctgagaatatgctggga

SEQ ID NO: 705 - DNA, 472 bp, Artificial; identical to SEQ ID NO: 704
  TaSBEIIa-D allele with mutations introduced by TALEN pair TaSBEIIa_T01

SEQ ID NO: 706 - DNA, 462 bp, Artificial
  TaSBEIIa-D allele with mutations introduced by TALEN pair TaSBEIIa_T01
  misc_feature (393): n is a or c or t or g
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaattttcggagccatcttgactaccggtaatgcctacccgctgctttcgctcattttgaattaaggcctttcacatgcaaatttggggaacntcaaagagacaaagactagggaccacccattttcatacagatcccctcgtggtctgagaatatgctggg

SEQ ID NO: 707 - DNA, 466 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 708 - DNA, 510 bp, Artificial
  TaSBEIIa-D allele with mutations introduced by TALEN pair TaSBEIIa_T01
  misc_feature (463); (494): n is a or c or t or g
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgatgcattcgcgaggtaccgagctcgaattcactggccgtcgttattttcggagccatcttgactaccggtaatgcctaccgctgcttcgctcatttttgaattaaggtccttcatcatgcaaatttggggaacatcaagagacaaagctagggnccaccatttcatacagatcccctcgttggtntgagaatatgctggga

SEQ ID NO: 709 - DNA, 465 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 710 - DNA, 510 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgatgcattcgcgaggtaccgagctcgaattcactggccgtcgttattttcggagccatcttgactaccggtaatgcctaccgctgcttcgctcattttgaattaaggtccttcatcatgcaaatttggggaacatcaaagagacaaagactaggggaccaccatttcatacagatcccctcgtggtctgagaatatgctggga

SEQ ID NO: 711 - DNA, 434 bp, Artificial
  TaSBEIIa-D allele with mutations introduced by TALEN pair TaSBEIIa_T01
  misc_feature (355): n is a or c or t or g
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttggatcccaaaaccaggagatcagggcagaaaaatatgacagagccatcttgactaccggtaatgcctacccgctgctttcgctcattttgaattaaaggnccttttcatcatgcaaatttggggaacatcaaagagacaaagactagggaccaccatttcatacagatcccctcgtggt

SEQ ID NO: 712 - DNA, 430 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaaccggtaatgcctacccgctgctttcgctcattttgaattaaggtcctttcatcatgcaaatttggggaacatcaaagagacaaagactagggaccacc

SEQ ID NO: 713 - DNA, 469 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttttcggagccatcttgactaccggtaatgcctacccgctgctttcgctcattttgaattaaggtcctttcatcatgcaaatttggggaacatcaaagagacaaagactagggaccaccattttcatacagatcccctcgtggtcctgagaatatgctggga

SEQ ID NO: 714 - DNA, 455 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgttttcggagccatcttgactaccggtaatgcctacccgctgctttcgctcattttgaaattaaggtcctttcatcatgcaaatttggggaacatcaaagagacaaagactagggaccaccattttcatacagatcccctcgtggtcc

SEQ ID NO: 715 - DNA, 470 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 716 - DNA, 468 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactttttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 717 - DNA, 430 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaaattaaggtcctttcatcatgcaaatttggggaacatcaaagagacaaagactagggaccacc

SEQ ID NO: 718 - DNA, 466 bp, Artificial; identical to SEQ ID NO: 707
  TaSBEIIa-D allele with mutations introduced by TALEN pair TaSBEIIa_T01

SEQ ID NO: 719 - DNA, 463 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaatttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 720 - DNA, 445 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagccatcttgactaccggtaatgcctacccgctgctttcgctcattttgaattaaggtccctttcatcatgcaaatttggggaacatcaaagagacaaagactagggaccaccatttcatacagatcccctcgtggtctgagaatatgctggg

SEQ ID NO: 721 - DNA, 470 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacatctccaggatacggtcctgggtgctgttccgggcgatctcgatcagctcgatgtactcgtggggcaacggcgccgtgctgtccgtggaggagctcctgatcggcggcgagatttttcggagccatcttgactaccggtaatgcctacccgctgctttcgctca

SEQ ID NO: 722 - DNA, 466 bp, Artificial; identical to SEQ ID NO: 707
  TaSBEIIa-D allele with mutations introduced by TALEN pair TaSBEIIa_T01

SEQ ID NO: 723 - DNA, 470 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgttttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 724 - DNA, 469 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgttttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 725 - DNA, 465 bp, Artificial
  TaSBEIIa-D allele with mutations introduced by TALEN pair TaSBEIIa_T01
  misc_feature (397): n is a or c or t or g
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacgaggggactgcagagaaacttcaatcttcagaaccgactcagggcattgtggaaacaatcactgatggtgtaaccaaaggagttaaggaactagtcgtgggggagaaaccgcgagttggtcccaaaaccaggagatggggcagaaaaatatgacgagattgacccattttcggagccatcttgactaccggtaatgcctacccgctgctttctgctcattttgaaattaaggcctttcatcatgcaaatttggggaacntcaaagagacaaagactagggaccaccattttcatacagatcccctcgtggtctgagaatatgctggg

SEQ ID NO: 726 - DNA, 471 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 727 - DNA, 464 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 728 - DNA, 569 bp, Artificial
  TaSBEIIa-D allele with mutations introduced by TALEN pair TaSBEIIa_T01
  misc_feature (549): n is a or c or t or g
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacatctccaggatacggtcctgggtgctgttccgggcgatctcgatcagctcgatgtactcgtggggcaacggcgccgtgctgtccgtggaggagctcctgatcggcggcgagattttttcggagccatcttgactaccggtaatgcctacccgctgctttcgctcattttgaattaaggtcctttcatcatgcaaatttggggaactcaaatggagacaaagactagggccaccattttcatanagatccccctgtggtctgag

SEQ ID NO: 729 - DNA, 443 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaattttcggagccatcttgactaccggtaatgcctacccgctgctttcgctcattttgaattaaggtcctttcatcatgcaaatttggggaacatcaaagagacaaagactagggaccaccattttcatacagat

SEQ ID NO: 730 - DNA, 470 bp, Artificial; identical to SEQ ID NO: 715
  TaSBEIIa-D allele with mutations introduced by TALEN pair TaSBEIIa_T01

SEQ ID NO: 731 - DNA, 444 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattttcatacagatt

SEQ ID NO: 732 - DNA, 466 bp, Artificial; identical to SEQ ID NO: 707
  TaSBEIIa-D allele with mutations introduced by TALEN pair TaSBEIIa_T01

SEQ ID NO: 733 - DNA, 580 bp, Artificial
  TaSBEIIa-D allele with mutations introduced by TALEN pair TaSBEIIa_T01
  misc_feature (537); (552): n is a or c or t or g
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgaacccaatcacactctccaggatacggtcctgggtgctgttccgggcgatctcgatcagctcgatgtactcgtggggcaacggcgccgtgctgtccgtggaggagctcctgatcggcggcgagatttttcggagccatcttgactaccggtaatgcctacccgctgctttcgctcattttgaattaaggtcctttcatcatgcaaatttggggaactcaaatggagacaaagactagggnccaccattttcatanagatccccctgtggtctgagaatatgct

SEQ ID NO: 734 - DNA, 468 bp, Artificial
  TaSBEIIa-D allele with mutations introduced by TALEN pair TaSBEIIa_T01
agatggatgtgcattctagcaagaacttcacaacataaatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 735 - DNA, 467 bp, Artificial
  TaSBEIIa-D allele with mutations introduced by TALEN pair TaSBEIIa_T01
  misc_feature (449): n is a or c or t or g
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattttcatacagattccccncgtggtcctgagaatatg

SEQ ID NO: 736 - DNA, 463 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 737 - DNA, 521 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactggcgggtgtcgggctggcttaactatgcggcatcagagcagattgtactgagagtgcaccatttcggagccatcttgactaccggtaatgcctacccgctgctttcgctcatttgaattaaggtcctttcatcatgcaaatttggggaacatcaaagagacaaagactagggaccaccatttcatacagatcccctcgtggtctgcagaatat

SEQ ID NO: 738 - DNA, 470 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgttttcggagccatcttgactaaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 739 - DNA, 475 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctgggactgat

SEQ ID NO: 740 - DNA, 469 bp, Artificial; identical to SEQ ID NO: 724
  TaSBEIIa-D allele with mutations introduced by TALEN pair TaSBEIIa_T01

SEQ ID NO: 741 - DNA, 520 bp, Artificial
  TaSBEIIa-D allele with mutations introduced by TALEN pair TaSBEIIa_T01
agatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactggcgggtgtcggggctggcttaactatgcggcatcagagcagattgtactgagagtgcaccatttcggagccatcttgactaccggtaatgcctacccgctgcttttcgctcattttgaattaaggtcctttcatcatgcaaaatttggggaacatcaaaagagacaaaagactagggaccaccatttcatacagatcccctcgtggtctgag

SEQ ID NO: 742 - DNA, 444 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggg

SEQ ID NO: 743 - DNA, 472 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 744 - DNA, 471 bp, Artificial; identical to SEQ ID NO: 726
  TaSBEIIa-D allele with mutations introduced by TALEN pair TaSBEIIa_T01

SEQ ID NO: 745 - DNA, 470 bp, Artificial; identical to SEQ ID NO: 715
  TaSBEIIa-D allele with mutations introduced by TALEN pair TaSBEIIa_T01

SEQ ID NO: 746 - DNA, 466 bp, Artificial; identical to SEQ ID NO: 707
  TaSBEIIa-D allele with mutations introduced by TALEN pair TaSBEIIa_T01

SEQ ID NO: 747 - DNA, 411 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaatcactgacggagccatcttgactaccggtaatgcctacccgctgcttcgctcattttgaattaagcctttcatcatgaaatttggggaacatcaaagagacaaagac

SEQ ID NO: 748 - DNA, 467 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 749 - DNA, 468 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 750 - DNA, 466 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 751 - DNA, 466 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaattttcggagccatcttgactaccggtaatgcctacccgctgctttcgctcattttgaattaaggtcctttcatcatgcaaatttggggaacatcaaagagacaaagactagggaccaccattttcatacagatcccctcgtggtcctgagaatatg

SEQ ID NO: 752 - DNA, 467 bp, Artificial; identical to SEQ ID NO: 748
  TaSBEIIa-D allele with mutations introduced by TALEN pair TaSBEIIa_T01

SEQ ID NO: 753 - DNA, 464 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagataccctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttttcggagccatcttgactaccggtaatgcctacccgctgctttcgctcatttgaattaaggtcctttcatccatgcaaatttggggaacatcaaagagacaaagactagggaccaccattttcatacagatcccctcgtggtctgagaatatgct

SEQ ID NO: 754 - DNA, 465 bp, Artificial; identical to SEQ ID NO: 709
  TaSBEIIa-D allele with mutations introduced by TALEN pair TaSBEIIa_T01

SEQ ID NO: 755 - DNA, 467 bp, Artificial; identical to SEQ ID NO: 748
  TaSBEIIa-D allele with mutations introduced by TALEN pair TaSBEIIa_T01

SEQ ID NO: 756 - DNA, 467 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 757 - DNA, 470 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgttttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 758 - DNA, 512 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacatctccaggatacggtcctgggtgctgttccgggcgatctcgatcagctcgatgtactcgtggggcaacggcgccgtgctgtccgtggaggagctcctgatcggcggcgagattttttcggagccatcttgactaccggtaatgcctacccgctgctttcgctcattttgaattaaggtcctttcatcatgcaaatttggggaac

SEQ ID NO: 759 - DNA, 463 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaatttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggg

SEQ ID NO: 760 - DNA, 470 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 761 - DNA, 436 bp, Artificial
  TaSBEIIa-D allele with mutations introduced by TALEN pair TaSBEIIa_T01
  misc_feature (282); (283); (285); (286); (312); (434): n is a or c or t or g
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcatcttcagaaccgactcagggcattgtggaaacaatcactgatggtgtaaccaaggagttaaggaactagtcgtggggagaaaccgcgagttgtcccaaaaccaggagatcgggcagaaannanntgaccaagaaaatttcgactcttganaccgtaatgcctacccgctgctttcgctcattttgaattaaggtccttttcatcatgcaaaattttggggaacacaaaagagacaaaagactagggaccaccattttcatacagatcccccncg

SEQ ID NO: 762 - DNA, 469 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaaatatacgagattgacccaacactgttttcggagccatcttgactaccggtaatgcctacccgctgctttcgctcattttgaattaaggtcctttcatcatgcaaaatttggggaacatcaaagagacaaagactagggaccaccattttcatacagatcccctcgtggtctgagaatatgctggga

SEQ ID NO: 763 - DNA, 465 bp, Artificial; identical to SEQ ID NO: 697
  TaSBEIIa-D allele with mutations introduced by TALEN pair TaSBEIIa_T01

SEQ ID NO: 764 - DNA, 450 bp, Artificial
  TaSBEIIa-D allele with mutations introduced by TALEN pair TaSBEIIa_T01
  misc_feature (448): n is a or c or t or g
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattttcatacagattccccncg

SEQ ID NO: 765 - DNA, 470 bp, Artificial; identical to SEQ ID NO: 757
  TaSBEIIa-D allele with mutations introduced by TALEN pair TaSBEIIa_T01

SEQ ID NO: 766 - DNA, 466 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatctggga

SEQ ID NO: 767 - DNA, 470 bp, Artificial; identical to SEQ ID NO: 715
  TaSBEIIa-D allele with mutations introduced by TALEN pair TaSBEIIa_T01

SEQ ID NO: 768 - DNA, 467 bp, Artificial; identical to SEQ ID NO: 756
  TaSBEIIa-D allele with mutations introduced by TALEN pair TaSBEIIa_T01

SEQ ID NO: 769 - DNA, 428 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgatgcattcgcgaggtaccgagctcgaattcactggccgtcgttattttcggagccatcttgactaccggtaatgcctacccgctgctttcgctcattttgaattaaggtcctttcatca

SEQ ID NO: 770 - DNA, 469 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggg

SEQ ID NO: 771 - DNA, 467 bp, Artificial; identical to SEQ ID NO: 756
  TaSBEIIa-D allele with mutations introduced by TALEN pair TaSBEIIa_T01

SEQ ID NO: 772 - DNA, 469 bp, Artificial; identical to SEQ ID NO: 724
  TaSBEIIa-D allele with mutations introduced by TALEN pair TaSBEIIa_T01

SEQ ID NO: 773 - DNA, 471 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgttttcggagccatcttgactaccggtaatgcctacccgctgcctttcgctcattttgaattaaggtcctttcatcatgcaaatttggggaacatcaaagagacaaagactagggaccaccattttcatacagatcccctcgtggtctgagaatatgctggga

SEQ ID NO: 774 - DNA, 469 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttttcggagtccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 775 - DNA, 471 bp, Artificial; identical to SEQ ID NO: 726
  TaSBEIIa-D allele with mutations introduced by TALEN pair TaSBEIIa_T01

SEQ ID NO: 776 - DNA, 467 bp, Artificial
  TaSBEIIa-D allele with mutations introduced by TALEN pair TaSBEIIa_T01
agatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 777 - DNA, 464 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 778 - DNA, 468 bp, Artificial
  TaSBEIIa-D allele with mutations introduced by TALEN pair TaSBEIIa_T01
agatggatgtgcattctagcaagaacttcacaacataatgcaccgtttggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgttttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 779 - DNA, 471 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactggcgggtgtcggggctggcttaactatgcggcatcagagcagattgtactgagagtgcaccattttcggagccatcttgactaccggtaatgcctacccgctgctttcgctcattttgaattaaggtcctttcatcatgcaaatttggggaacatcaaagaga

SEQ ID NO: 780 - DNA, 465 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattttcatacagatcccctcgtggtcctgagaatatg

SEQ ID NO: 781 - DNA, 463 bp, Artificial; identical to SEQ ID NO: 736
  TaSBEIIa-D allele with mutations introduced by TALEN pair TaSBEIIa_T01

SEQ ID NO: 782 - DNA, 466 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 783 - DNA, 464 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaatttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 784 - DNA, 420 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactggcgggtgtcggggctggcttaactatgcggcatcagagcagattgtactgagagtgcaccattttcggagccatcttgactaccggtaatgcctacccgctgctttcgctca

SEQ ID NO: 785 - DNA, 444 bp, Artificial; identical to SEQ ID NO: 742
  TaSBEIIa-D allele with mutations introduced by TALEN pair TaSBEIIa_T01

SEQ ID NO: 786 - DNA, 530 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaaaacgtaaaacggcttgtcccgcgtcatgcggcgaccgagttgctcttgcccggcgtttttcggaagccatcttgactaccggtaatgcctacccgctgctttcgctcattttgaattaaggtcctttcatcatgcaaaatttggggaacatcaaagagacaaagactagggacccaccatttcatacagatcccctcgtggtctgagaatatgctggga

SEQ ID NO: 787 - DNA, 444 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgactaccggtaatgcctacccgctgctttcgctcattttgaattaaggtcctttcatcatgcaaatttggggaacatcaagagacaaagactagggaccaccatttcatacagatcccctcgtggtctgagaatatgct

SEQ ID NO: 788 - DNA, 562 bp, Artificial
  TaSBEIIa-D allele with mutations introduced by TALEN pair TaSBEIIa_T01
  misc_feature (501); (521); (535): n is a or c or t or g
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaatatacgagattgacccaacacatctccaggatacggtcctgggtgctgttccgggcgatctcgatcagctcgatgtactcgtggggcaacggcgccgtgctgtccgtggaggagctcctgatcggcggcgagatttttcggagccatcttgactaccggtaatgcctacccgctgctttcgctcatttgaataagtccttcatcagcaattgggacncaatggagacaagactaggnccaccatttcatanagatcccctgtggtctgagaatatgct

SEQ ID NO: 789 - DNA, 471 bp, Artificial; identical to SEQ ID NO: 726
  TaSBEIIa-D allele with mutations introduced by TALEN pair TaSBEIIa_T01

SEQ ID NO: 790 - DNA, 570 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacatctccaggatacggtcctgggtgctgttccgggcgatctcgatcagctcgatgtactcgtggggcaacggcgccgtgctgtccgtggaggagctcctgatcggcggcgagatttttcggagccatcttgactaccggtaatgcctacccgctgctttcgctcattttgaattaaggtcctttcatcatgcaaatttggggaactcaaatggagacaaagactagggccaaccattttccatacagatccccctgtggtctgag

SEQ ID NO: 791 - DNA, 464 bp, Artificial; identical to SEQ ID NO: 777
  TaSBEIIa-D allele with mutations introduced by TALEN pair TaSBEIIa_T01

SEQ ID NO: 792 - DNA, 464 bp, Artificial; identical to SEQ ID NO: 783
  TaSBEIIa-D allele with mutations introduced by TALEN pair TaSBEIIa_T01

SEQ ID NO: 793 - DNA, 466 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 794 - DNA, 469 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaatatacgagattgacccaacactgttttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 795 - DNA, 419 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaaaaccgtaaaaccggcttgtccgcgatcaatgcggcgccgagttgctcttgccccggcgttttttcggagccatcttgactaccggtaatgctacccgcgctttcgctca

SEQ ID NO: 796 - DNA, 466 bp, Artificial
  TaSBEIIa-D allele with mutations introduced by TALEN pair TaSBEIIa_T01
agatggatgtgcattctagcaagaacttcacaacataatgcaccgtttggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 797 - DNA, 467 bp, Artificial
  TaSBEIIa-D allele with mutations introduced by TALEN pair TaSBEIIa_T01
agatggatgtgcattctagcaagaacttcacaacataaatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 798 - DNA, 573 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacatctccaggatacggtcctgggtgctgttccgggcgatctcgatcagctcgatgtactcgtggggcaacggcgccgtgctgtccgtggaggagctcctgatcggcggcgagatttttcggagccatcttgactaccggtaatgcctacccgctgctttcgctcattttgaattaaggtcctttcatcatgcaaatttggggaactcaaatggaagacaaagacttagggacccaccattttcaatacagatcccctcgtggtctgag

SEQ ID NO: 799 - DNA, 469 bp, Artificial; identical to SEQ ID NO: 724
  TaSBEIIa-D allele with mutations introduced by TALEN pair TaSBEIIa_T01

SEQ ID NO: 800 - DNA, 467 bp, Artificial; identical to SEQ ID NO: 748
  TaSBEIIa-D allele with mutations introduced by TALEN pair TaSBEIIa_T01

SEQ ID NO: 801 - DNA, 468 bp, Artificial; identical to SEQ ID NO: 749
  TaSBEIIa-D allele with mutations introduced by TALEN pair TaSBEIIa_T01

SEQ ID NO: 802 - DNA, 469 bp, Artificial; identical to SEQ ID NO: 724
  TaSBEIIa-D allele with mutations introduced by TALEN pair TaSBEIIa_T01

SEQ ID NO: 803 - DNA, 508 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactggcgggtgtcggggctggcttaactatgcggcatcagagcagattgtactgagagtgcaccatttcggagccatcttgactaccggtaatgcctacccgctgctttcgctcatttgaattaaggtccttcatcatgcaaatttggggaacatcaaagagacaaagactagggaccaccatttcatacagatcccctcgtgg

SEQ ID NO: 804 - DNA, 468 bp, Artificial; identical to SEQ ID NO: 734
  TaSBEIIa-D allele with mutations introduced by TALEN pair TaSBEIIa_T01

SEQ ID NO: 805 - DNA, 467 bp, Artificial; identical to SEQ ID NO: 748
  TaSBEIIa-D allele with mutations introduced by TALEN pair TaSBEIIa_T01

SEQ ID NO: 806 - DNA, 413 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaatcactgaaaaccgtaaaacggcttgtccgcgatcaatgcggcgccgagttgctcttgcccggcgttttttcggagccatcttgactaccggtaatgctacccgcgcttt

SEQ ID NO: 807 - DNA, 465 bp, Artificial; identical to SEQ ID NO: 697
  TaSBEIIa-D allele with mutations introduced by TALEN pair TaSBEIIa_T01

SEQ ID NO: 808 - DNA, 471 bp, Artificial; identical to SEQ ID NO: 726
  TaSBEIIa-D allele with mutations introduced by TALEN pair TaSBEIIa_T01

SEQ ID NO: 809 - DNA, 468 bp, Artificial; identical to SEQ ID NO: 749
  TaSBEIIa-D allele with mutations introduced by TALEN pair TaSBEIIa_T01

SEQ ID NO: 810 - DNA, 470 bp, Artificial; identical to SEQ ID NO: 723
  TaSBEIIa-D allele with mutations introduced by TALEN pair TaSBEIIa_T01

SEQ ID NO: 811 - DNA, 519 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacatctccaggatacggtcctgggtgctgttccgggcgatctcgatcagctcgatgtactcgtggggcaacggcgccgtgctgtccgtggaggagctcctgatcggcggcgagatttttcggagccatcttgactaccggtaatgcctacccgctgctttcgctcattttgaattaaggtcctttcatcatgcaaatttggggaactcaaatgg

SEQ ID NO: 812 - DNA, 467 bp, Artificial; identical to SEQ ID NO: 748
  TaSBEIIa-D allele with mutations introduced by TALEN pair TaSBEIIa_T01

SEQ ID NO: 813 - DNA, 470 bp, Artificial; identical to SEQ ID NO: 757
  TaSBEIIa-D allele with mutations introduced by TALEN pair TaSBEIIa_T01

SEQ ID NO: 814 - DNA, 469 bp, Artificial; identical to SEQ ID NO: 724
  TaSBEIIa-D allele with mutations introduced by TALEN pair TaSBEIIa_T01

SEQ ID NO: 815 - DNA, 466 bp, Artificial; identical to SEQ ID NO: 707
  TaSBEIIa-D allele with mutations introduced by TALEN pair TaSBEIIa_T01

SEQ ID NO: 816 - DNA, 472 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaattttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 817 - DNA, 465 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccattttcggagccatcttgactaccggtaatgcctacccgctgcttttcgctcattttgaattaaggtcctttcatcatgcaaatttggggaacatcaaagagacaaagactagggaccaccattttcatacagatcccctcgtggtctgagaatatgctggga

SEQ ID NO: 818 - DNA, 467 bp, Artificial; identical to SEQ ID NO: 748
  TaSBEIIa-D allele with mutations introduced by TALEN pair TaSBEIIa_T01

SEQ ID NO: 819 - DNA, 463 bp, Artificial; identical to SEQ ID NO: 736
  TaSBEIIa-D allele with mutations introduced by TALEN pair TaSBEIIa_T01

SEQ ID NO: 820 - DNA, 471 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 821 - DNA, 465 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 822 - DNA, 470 bp, Artificial
  TaSBEIIa-D allele with mutations introduced by TALEN pair TaSBEIIa_T01
  misc_feature (446): n is a or c or t or g
agatggatgtgcattctagcaagaacttcacaacataaatgcaccgtttgggggtttcgtcagtctgctctacaattgctatttttcgtgctgtagatacctgaagatatcgaggagcaaacggcggaagcgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaaccggtaatgcctacccgctgctttcgctcattttgaattaaggtcctttcatcatgcaaatttggggaaacatcaaagagacaaagactagggaccaccattttcttaaggancccctcgtggtctgagaatatgct

SEQ ID NO: 823 - DNA, 470 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttttttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 824 - DNA, 466 bp, Artificial; identical to SEQ ID NO: 782
  TaSBEIIa-D allele with mutations introduced by TALEN pair TaSBEIIa_T01

SEQ ID NO: 825 - DNA, 467 bp, Artificial; identical to SEQ ID NO: 756
  TaSBEIIa-D allele with mutations introduced by TALEN pair TaSBEIIa_T01

SEQ ID NO: 826 - DNA, 470 bp, Artificial; identical to SEQ ID NO: 757
  TaSBEIIa-D allele with mutations introduced by TALEN pair TaSBEIIa_T01

SEQ ID NO: 827 - DNA, 462 bp, Artificial
  TaSBEIIa-D allele with mutations introduced by TALEN pair TaSBEIIa_T01
agatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaatatacgagattgacccattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 828 - DNA, 469 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 829 - DNA, 467 bp, Artificial; identical to SEQ ID NO: 756
  TaSBEIIa-D allele with mutations introduced by TALEN pair TaSBEIIa_T01

SEQ ID NO: 830 - DNA, 465 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaattttcggagccatcttgactaccggtaatgcctacccgctgcttttcgctcattttgaattaaggtcctttcatcatgcaaatttggggaacatcaaagagacaaagactagggaccaccattttcatacagatcccctcgtggtctgagaatatgctggga

SEQ ID NO: 831 - DNA, 427 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaaattaaggtcctttcatcatgcaaatttggggaacatcaaagagacaaagactagggacca

SEQ ID NO: 832 - DNA, 462 bp, Artificial
  TaSBEIIa-D allele with mutations introduced by TALEN pair TaSBEIIa_T01
  misc_feature (392): n is a or c or t or g
agatggatgtgcattctagcaagaacttcacaacataatgcaccgtttggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaatttcggagccatcttgactaccggtaatgcctacccgctgctttcgctcattttgaattaaggcctttcatcatgcaaatttggggaacntcaaagagacaaagactagggaccacccattttcatacagatcccctcgtggtctgagaatatgctggga

SEQ ID NO: 833 - DNA, 471 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaattttcggagccatcttgactaccggtaatgcctacccgctgctttcgctcattttgaattaaggtcctttcacatgcaaatttggggaacatcaaagagacaaagactagggaccaccattttcatacagatcccctcgtggtctgagaatatgctggga

SEQ ID NO: 834 - DNA, 470 bp, Artificial; identical to SEQ ID NO: 715
  TaSBEIIa-D allele with mutations introduced by TALEN pair TaSBEIIa_T01

SEQ ID NO: 835 - DNA, 464 bp, Artificial; identical to SEQ ID NO: 783
  TaSBEIIa-D allele with mutations introduced by TALEN pair TaSBEIIa_T01

SEQ ID NO: 836 - DNA, 471 bp, Artificial; identical to SEQ ID NO: 726
  TaSBEIIa-D allele with mutations introduced by TALEN pair TaSBEIIa_T01

SEQ ID NO: 837 - DNA, 463 bp, Artificial; identical to SEQ ID NO: 719
  TaSBEIIa-D allele with mutations introduced by TALEN pair TaSBEIIa_T01

SEQ ID NO: 838 - DNA, 465 bp, Artificial; identical to SEQ ID NO: 697
  TaSBEIIa-D allele with mutations introduced by TALEN pair TaSBEIIa_T01

SEQ ID NO: 839 - DNA, 471 bp, Artificial; identical to SEQ ID NO: 726
  TaSBEIIa-D allele with mutations introduced by TALEN pair TaSBEIIa_T01

SEQ ID NO: 840 - DNA, 470 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggg

SEQ ID NO: 841 - DNA, 466 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaatatacgagattgacccaacactttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 842 - DNA, 469 bp, Artificial; identical to SEQ ID NO: 770
  TaSBEIIa-D allele with mutations introduced by TALEN pair TaSBEIIa_T01

SEQ ID NO: 843 - DNA, 466 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccagggagatgggcaagaaatatacgagattgacccaacactttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 844 - DNA, 471 bp, Artificial; identical to SEQ ID NO: 726
  TaSBEIIa-D allele with mutations introduced by TALEN pair TaSBEIIa_T01

SEQ ID NO: 845 - DNA, 467 bp, Artificial; identical to SEQ ID NO: 756
  TaSBEIIa-D allele with mutations introduced by TALEN pair TaSBEIIa_T01

SEQ ID NO: 846 - DNA, 467 bp, Artificial; identical to SEQ ID NO: 748
  TaSBEIIa-D allele with mutations introduced by TALEN pair TaSBEIIa_T01

SEQ ID NO: 847 - DNA, 467 bp, Artificial; identical to SEQ ID NO: 748
  TaSBEIIa-D allele with mutations introduced by TALEN pair TaSBEIIa_T01

SEQ ID NO: 848 - DNA, 467 bp, Artificial; identical to SEQ ID NO: 748
  TaSBEIIa-D allele with mutations introduced by TALEN pair TaSBEIIa_T01

SEQ ID NO: 849 - DNA, 449 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaaatatacgagattgacccaacactgaaaacgtaaaacggcttgtcccgcgtcatgcggcgaccgagttgctcttgcccggcgtttttccggagccattcttgactaccggtaatgcctacccgctgctttcgctcattttgaattaaggtcctttcatcatgcaaa

SEQ ID NO: 850 - DNA, 468 bp, Artificial; identical to SEQ ID NO: 749
  TaSBEIIa-D allele with mutations introduced by TALEN pair TaSBEIIa_T01

SEQ ID NO: 851 - DNA, 471 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgttttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 852 - DNA, 469 bp, Artificial
  TaSBEIIa-D allele with mutations introduced by TALEN pair TaSBEIIa_T01
agatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgttttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 853 - DNA, 396 bp, Artificial
  TaSBEIIa-D allele with mutations introduced by TALEN pair TaSBEIIa_T01
agatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaatatacgagattgacccaatcactggccgggtgtcggggctggcgttaactatgcggcatcagagcagattgtactgagagtgcaccattttcggagccatcttgactaccgg

SEQ ID NO: 854 - DNA, 482 bp, Artificial
  TaSBEIIa-D allele with mutations introduced by TALEN pair TaSBEIIa_T01
  misc_feature (410): n is a or c or t or g
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttggatcccaaaaccaggagatcaggggcagaaaaatatgacagagattgacccaatttttcggacgccaattcttgactaccggtaatgcctacccgctcgctttctgctcatttttgaaattaaggtcctttcatcatgcaaatttggggaacntcaaagagacaaaagactagggaccacccattttcatacagatccccctcgtggtctgagaatatgctggga

SEQ ID NO: 855 - DNA, 453 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagataccctgaagatatcgaggagcaaacggcggaagtgaacatgacagggggactgcagagaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttcggagccatcttgactaccggtaatgcctacccgctgctttcgctcattttgaattaaggtcctttcatcatgcaaatttggggaacatcaagagacaaagactagggaccaccattttcatacagatcccctcgtggtctgag

SEQ ID NO: 856 - DNA, 467 bp, Artificial
  TaSBEIIa-D allele with mutations introduced by TALEN pair TaSBEIIa_T01
agatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggacgtgcagagaaacttcaatcttcagaaccgactcagggcattgtggaaacaatcactgatggtgtaaccaaaggagttaaggaactagtcgtggggagaaaccgcgagttgtcccaaaaccaggagatgggcagaaaatatacgagattgacccaacacttttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 857 - DNA, 468 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 858 - DNA, 464 bp, Artificial; identical to SEQ ID NO: 783
  TaSBEIIa-D allele with mutations introduced by TALEN pair TaSBEIIa_T01

SEQ ID NO: 859 - DNA, 471 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgttttcggagccatcttgactaccggtaatgcctacccgctgctttcgctcattttgaattaaggtcctttcatcatgcaaattttggggaacatcaaagagacaaagactagggaccaccattttcatacagatcccctcgtggtctgagaatatgctggga

SEQ ID NO: 860 - DNA, 470 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaattttcggagccatcttgactaccggtaatgcctacccgctgctttcgctcattttgaattaaggtcctttcacatgcaaatttggggaacatcaaagagacaaagactagggaccaccattttcatacagatcccctcgtggtctgagaatatgctggg

SEQ ID NO: 861 - DNA, 473 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaattttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 862 - DNA, 471 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 863 - DNA, 424 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgactaccggtaatgcctacccgctgctttcgctcattttgaattaaggtcctttcatcatgcaaattttggggaacatcaaagagacaaagactagggaccaccatttcatacagat

SEQ ID NO: 864 - DNA, 463 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaatttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 865 - DNA, 519 bp, Artificial; identical to SEQ ID NO: 811
  TaSBEIIa-D allele with mutations introduced by TALEN pair TaSBEIIa_T01

SEQ ID NO: 866 - DNA, 470 bp, Artificial; identical to SEQ ID NO: 757
  TaSBEIIa-D allele with mutations introduced by TALEN pair TaSBEIIa_T01

SEQ ID NO: 867 - DNA, 472 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 868 - DNA, 450 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaatatacgagattgacccaacactgactaccggtaatgcctacccgctgctttcgctcattttgaattaaggtcctttcatcatgcaaatttggggaacatcaaagagacaaagactagggaccaccatttcatacagatcccctcgtggtctgagaatatgctggg

SEQ ID NO: 869 - DNA, 467 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 870 - DNA, 471 bp, Artificial; identical to SEQ ID NO: 726
  TaSBEIIa-D allele with mutations introduced by TALEN pair TaSBEIIa_T01

SEQ ID NO: 871 - DNA, 464 bp, Artificial; identical to SEQ ID NO: 783
  TaSBEIIa-D allele with mutations introduced by TALEN pair TaSBEIIa_T01

SEQ ID NO: 872 - DNA, 395 bp, Artificial
  TaSBEIIa-D allele with mutations introduced by TALEN pair TaSBEIIa_T01
  misc_feature (170): n is a or c or t or g
agatggatgtgcattctagcaagaacttcacaacataaatgcaccgtttgggggtttcgtcagtctgctctacaattgctatttttcgtgcgtagatacctgaagatatcgaggagcaaacggcggaagtgaacatgacagggggactgcagagaaacttcaatcttcanaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgatgcattcgcgaggtaccgagctcgaattcactggccgtcgttattttcggagccatcttgactaccggtaatgcctacccgctgc

SEQ ID NO: 873 - DNA, 464 bp, Artificial; identical to SEQ ID NO: 783
  TaSBEIIa-D allele with mutations introduced by TALEN pair TaSBEIIa_T01

SEQ ID NO: 874 - DNA, 525 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacatctccaggatacggtcctgggtgctgttccgggcgatctcgatcagctcgatgtactcgtggggcaaacggcgccgtgctgtccgtggaggagctcctgatcggcggcgagattttttcggagccatcttgactaccggtaatgcctacccgctgctttcgctcatttttgaattaaggtcctttcatcatgcaaatttggggaacatcaaagagac

SEQ ID NO: 875 - DNA, 470 bp, Artificial; identical to SEQ ID NO: 757
  TaSBEIIa-D allele with mutations introduced by TALEN pair TaSBEIIa_T01

SEQ ID NO: 876 - DNA, 472 bp, Artificial; identical to SEQ ID NO: 743
  TaSBEIIa-D allele with mutations introduced by TALEN pair TaSBEIIa_T01

SEQ ID NO: 877 - DNA, 467 bp, Artificial; identical to SEQ ID NO: 748
  TaSBEIIa-D allele with mutations introduced by TALEN pair TaSBEIIa_T01

SEQ ID NO: 878 - DNA, 466 bp, Artificial; identical to SEQ ID NO: 782
  TaSBEIIa-D allele with mutations introduced by TALEN pair TaSBEIIa_T01

SEQ ID NO: 879 - DNA, 528 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactggcgggtgtcggggctggcttaactatgcggcatcagagcagattgtactgagagtgcaccatttcggagccatcttgactaccggtaatgcctacccgctgctttcgctcatttgaattaaggtcctttcatcatgcaaaatttggggaacatcaaaagagacaaaagactagggaccaccatttcatacagatcccctcgtggtctgcagaatatgct

SEQ ID NO: 880 - DNA, 470 bp, Artificial; identical to SEQ ID NO: 757
  TaSBEIIa-D allele with mutations introduced by TALEN pair TaSBEIIa_T01

SEQ ID NO: 881 - DNA, 475 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaattttcggagccatcttgactaccggtaatgcctacccgctgctttcgctcattttgaattaaggtcctttcatcatgcaaatttggggaacatcaaagagacaaagactagggaccacccatttttcatacagatccccctcgtggtctgagaatatgctggga

SEQ ID NO: 882 - DNA, 476 bp, Artificial
  TaSBEIIa-D allele with mutations introduced by TALEN pair TaSBEIIa_T01
  misc_feature (453): n is a or c or t or g
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaattttcggagccatcttgactaccggtaatgcctacccgctgctttcgcttcattttgaattaaggtcctttcatcatgcaaatttggggaacatcaaagagacaaagactagggaccaccattttcatacaagtatcccccncgctggtctgagaatatgcggga

SEQ ID NO: 883 - DNA, 467 bp, Artificial; identical to SEQ ID NO: 748
  TaSBEIIa-D allele with mutations introduced by TALEN pair TaSBEIIa_T01

SEQ ID NO: 884 - DNA, 470 bp, Artificial; identical to SEQ ID NO: 723
  TaSBEIIa-D allele with mutations introduced by TALEN pair TaSBEIIa_T01

SEQ ID NO: 885 - DNA, 467 bp, Artificial
  TaSBEIIa-D allele with mutations introduced by TALEN pair TaSBEIIa_T01
agatggatgtgcattctagcaagaacttcacaacataatgcaccgtttggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgttttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggg

SEQ ID NO: 886 - DNA, 472 bp, Artificial; identical to SEQ ID NO: 743
  TaSBEIIa-D allele with mutations introduced by TALEN pair TaSBEIIa_T01

SEQ ID NO: 887 - DNA, 471 bp, Artificial
  TaSBEIIa-D allele with mutations introduced by TALEN pair TaSBEIIa_T01
agatggatgtgcattctagcaagaacttcacaacataaatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggg

SEQ ID NO: 888 - DNA, 410 bp, Artificial
  TaSBEIIa-D allele with mutations introduced by TALEN pair TaSBEIIa_T01
agatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgaacccaatcactgacggagccatcttgactaccggtaatgcctacccgctgcttcgctcattttgaattaagtccttcatcatgaaatttggggaacatcaaagagacaagac

SEQ ID NO: 889 - DNA, 471 bp, Artificial; identical to SEQ ID NO: 726
  TaSBEIIa-D allele with mutations introduced by TALEN pair TaSBEIIa_T01

SEQ ID NO: 890 - DNA, 473 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaattttcggagccatcttgactaccggtaatgcctacccgctgctttcgctcaattttgaattaaggtcctttcatcatgcaaatttggggaacatcaaagagacaaagactagggaccaccattttcatacagatcccctcgtggtctgagaatatgctggga

SEQ ID NO: 891 - DNA, 465 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaatttcggagccatcttgactaccggtaatgcctacccgctgctttcgctcattttgaattaaggtcctttcatcatgcaaattttggggaacatcaaagagacaaagactagggaccaccattttcatacagatcccctcgtggtctgagaatatgctggga

SEQ ID NO: 892 - DNA, 466 bp, Artificial; identical to SEQ ID NO: 707
  TaSBEIIa-D allele with mutations introduced by TALEN pair TaSBEIIa_T01

SEQ ID NO: 893 - DNA, 455 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactggcgggtgtcggggctggcttaactatgcggcatcagagcagattgtactgaggagtgcaccattttcggagccatcttgactaccggtaatgcctacccgctgctttcgctcattttgaattaaggtcctttcatcatgcaaattt

SEQ ID NO: 894 - DNA, 468 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 895 - DNA, 470 bp, Artificial; identical to SEQ ID NO: 757
  TaSBEIIa-D allele with mutations introduced by TALEN pair TaSBEIIa_T01

SEQ ID NO: 896 - DNA, 453 bp, Artificial
  TaSBEIIa-D allele with mutations introduced by TALEN pair TaSBEIIa_T01
agatggatgtgcattctagcaagaacttcacaacataaatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgactaccggtaatgcctacccgctgctttcgctcattttgaattaaggtcctttcatcatgcaaatttggggaacatcaaagagacaaagactaggggaccaccatttcatacagatcccctcgtggtctgagaatatgctggg

SEQ ID NO: 897 - DNA, 575 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacatctccaggatacggtcctgggtgctgttccgggcgatctcgatcagctcgatgtactcgtggggcaacggcgccgtgctgtccgtggaggagctcctgatcggcggcgagatttttcggagccatcttgactaccggtaatgcctacccgctgctttcgctcatttttgaattaaggtcctttcatcatgcaaatttggggaactcaaatggaagacaaagacttagggacccaccattttcaatacagatcccctcgtggtctgag

SEQ ID NO: 898 - DNA, 467 bp, Artificial; identical to SEQ ID NO: 748
  TaSBEIIa-D allele with mutations introduced by TALEN pair TaSBEIIa_T01

SEQ ID NO: 899 - DNA, 467 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 900 - DNA, 466 bp, Artificial; identical to SEQ ID NO: 793
  TaSBEIIa-D allele with mutations introduced by TALEN pair TaSBEIIa_T01

SEQ ID NO: 901 - DNA, 466 bp, Artificial
  TaSBEIIa-D allele with mutations introduced by TALEN pair TaSBEIIa_T01
agatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 902 - DNA, 469 bp, Artificial
  TaSBEIIa-D allele with mutations introduced by TALEN pair TaSBEIIa_T01
agatggatgtgcattctagcaagaacttcacaacataaatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcacatgcaaatttggggaacatcaaagagacaaagactagggaccaccattttcatacagatcccctcgtggtctgagaatatgctggg

SEQ ID NO: 903 - DNA, 470 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaaattaaggtcctttcacatgcaaatttggggaacatcaaagagacaaagactagggaccaccattttcatacagatcccctcgtggtctgagaatatgctggga

SEQ ID NO: 904 - DNA, 466 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccattttcggagccatcttgactaccggtaatgcctacccgctgctttcgctcattttgaattaaggtcctttcatcatgcaaatttggggaacatcaaagagacaaagactagggaccaccattttcatacagtatcccctcgctggtctgagaatatgctggga

SEQ ID NO: 905 - DNA, 469 bp, Artificial
  TaSBEIIa-D allele with mutations introduced by TALEN pair TaSBEIIa_T01
agatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaaatatacgagattgacccaacacttcggagccatcttgactaccggtaatgcctacccgctgctttcgctcatttttgaaattaaggtcctttcatcatgcaaattttgggggaacatcaaaagagacaaagactagggaccaccattttcatacagatccccctcgtggtctgagaatatgctgga

SEQ ID NO: 906 - DNA, 466 bp, Artificial; identical to SEQ ID NO: 793
  TaSBEIIa-D allele with mutations introduced by TALEN pair TaSBEIIa_T01

SEQ ID NO: 907 - DNA, 464 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattttcatacagatccccctcgtggtctgagaata

SEQ ID NO: 908 - DNA, 471 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacatctccaggatacggtcctgggtgctgttccgggcgatctcgatcagctcgatgtactcgtggggcaacggcgccgtgctgtccgtggaggagctcctgatcggcggcgagattttttcggagccatcttgactaccggtaatgcctacccgctgctttcgctca

SEQ ID NO: 909 - DNA, 430 bp, Artificial
  TaSBEIIa-D allele with mutations introduced by TALEN pair TaSBEIIa_T01
  misc_feature (352): n is a or c or t or g
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttggtcccaaaaccaggagatggggcagaaaaatatgacgagccatcttgactaccggtaatgcctacccgctgctttcgctcattttgaattaaggncctttcatcatgcaaatttggggaacatcaaagagacaaagactagggaccaccatttcatacagatcccctcgtggt

SEQ ID NO: 910 - DNA, 427 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcatcatgcaaatttggggaacatcaaagagacaaagactagggacca

SEQ ID NO: 911 - DNA, 467 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactttcggagccatcttgactaccggtaatgcctacccgctgctttcgctcattttgaattaaggtcctttcatcatgcaaattttggggaacatcaaagagacaaagactagggaccaccattttcatacagatcccctcgtggtctgagaatatctggga

SEQ ID NO: 912 - DNA, 464 bp, Artificial; identical to SEQ ID NO: 783
  TaSBEIIa-D allele with mutations introduced by TALEN pair TaSBEIIa_T01

SEQ ID NO: 913 - DNA, 470 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactttttcggagccatcttgactaccggtaaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 914 - DNA, 463 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 915 - DNA, 470 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 916 - DNA, 577 bp, Artificial
  TaSBEIIa-D allele with mutations introduced by TALEN pair TaSBEIIa_T01
  misc_feature (534): n is a or c or t or g
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacatctccaggatacggtcctgggtgctgttccgggcgatctcgatcagctcgatgtactcgtggggcaacggcgccgtgctgtccgtggaggagctcctgatcggcggcgagatttttcggagccatcttgactaccggtaatgcctacccgctgctttcgctcattttgaattaaggtccttcatcatgcaaatttggggaactcaaatggagacaaagactagggngccaccattttcatacagatcccctgtggtctgagaatatgct

SEQ ID NO: 917 - DNA, 472 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcatttttgaattaaggtcctttcatcatgcaaatttggggaacatcaaagagacaaagactagggaccaccattttcatacagatcccctcgtggtctgagaatatgctggga

SEQ ID NO: 918 - DNA, 467 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaaatatacgagattgacccaacacttttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 919 - DNA, 470 bp, Artificial; identical to SEQ ID NO: 760
  TaSBEIIa-D allele with mutations introduced by TALEN pair TaSBEIIa_T01

SEQ ID NO: 920 - DNA, 449 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgactaccggtaatgcctacccgctgctttcgctcattttgaattaaggtcctttcatcatgcaaatttggggaacatcaaagagacaaagactagggaccaccatttcatacagatcccctcgtggtctgagaatatgctggg

SEQ ID NO: 921 - DNA, 471 bp, Artificial; identical to SEQ ID NO: 726
  TaSBEIIa-D allele with mutations introduced by TALEN pair TaSBEIIa_T01

SEQ ID NO: 922 - DNA, 471 bp, Artificial
  TaSBEIIa-D allele with mutations introduced by TALEN pair TaSBEIIa_T01
agatggatgtgcattctagcaagaacttcacaacataaatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 923 - DNA, 471 bp, Artificial; identical to SEQ ID NO: 862
  TaSBEIIa-D allele with mutations introduced by TALEN pair TaSBEIIa_T01

SEQ ID NO: 924 - DNA, 467 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacatttcggagccatcttgactaccggtaatgcctacccgctgctttcgctcattttgaattaaggtcctttcatcatgcaaatttggggaacatcaaagagacaaagactagggaccaccattttcatacagatcccctcgtggtcctgagaatatgctggga

SEQ ID NO: 925 - DNA, 486 bp, Artificial
  TaSBEIIa-D allele with mutations introduced by TALEN pair TaSBEIIa_T01
  misc_feature (443): n is a or c or t or g
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactggcgggtgtcggggctggcttaactatgcggcatcagagcagattgtactgagagtgcaccatttcggagccatcttgactaccggtaatgcctacccgctgctttcgctcatttgaattaaggtcctttcatcntgcaaatttggggaacatcaaagagacaaagactgggaccacc

SEQ ID NO: 926 - DNA, 468 bp, Artificial; identical to SEQ ID NO: 749
  TaSBEIIa-D allele with mutations introduced by TALEN pair TaSBEIIa_T01

SEQ ID NO: 927 - DNA, 525 bp, Artificial
  TaSBEIIa-D allele with mutations introduced by TALEN pair TaSBEIIa_T01
  misc_feature (441); (467); (491); (513): n is a or c or t or g
agatggatgtgcattctagcaagaacttcacaacataaatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaaaacgtaaaacggcttgtcccgcgtcatgcggcgaccgagttgctcttgcccggcgtttttcggagccatcttgactaccggtaatgcctacccgctgctttcgctcattttgaattaaggtccttcatnatgcaaatttgggaacatcaaagagncaaagactgggagccaccatttcnacagatcccctcgtggtctganaatatgctggga

SEQ ID NO: 928 - DNA, 469 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgcgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 929 - DNA, 469 bp, Artificial; identical to SEQ ID NO: 828
  TaSBEIIa-D allele with mutations introduced by TALEN pair TaSBEIIa_T01

SEQ ID NO: 930 - DNA, 455 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaatatacgagattgacccaacactgattttcggagccatcttgactaccggtaatgcctacccgctgctttcgctcattttgaattaaggtcctttcatcatgcaaattttggggaacatcaaagagacaaagactagggaccacccattttcatacagatcccctcgtggt

SEQ ID NO: 931 - DNA, 467 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 932 - DNA, 471 bp, Artificial; identical to SEQ ID NO: 726
  TaSBEIIa-D allele with mutations introduced by TALEN pair TaSBEIIa_T01

SEQ ID NO: 933 - DNA, 467 bp, Artificial; identical to SEQ ID NO: 748
  TaSBEIIa-D allele with mutations introduced by TALEN pair TaSBEIIa_T01

SEQ ID NO: 934 - DNA, 467 bp, Artificial; identical to SEQ ID NO: 748
  TaSBEIIa-D allele with mutations introduced by TALEN pair TaSBEIIa_T01

SEQ ID NO: 935 - DNA, 470 bp, Artificial; identical to SEQ ID NO: 757
  TaSBEIIa-D allele with mutations introduced by TALEN pair TaSBEIIa_T01

SEQ ID NO: 936 - DNA, 528 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaaaacgtaaaacggcttgtcccgcgtcatgcggcgaccgagttgctcttgcccggcgtttttcggagccatcttgactaccggtaatgcctacccgctgctttcgctcattttgaattaaggtcctttcatcatgcaaaatttggggaacatcaaagagacaaaagactagggaccaccatttcatacagatcccctcgtggtctgagaatatgctggg

SEQ ID NO: 937 - DNA, 468 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactttcggagccatcttgactaccggtaatgcctacccgctgctttcgctcattttgaattaaggtcctttcatcatgcaaatttggggaacatcaaagagacaaagactagggaccaccattttcatacagatcccctcgtggtcctgagaatatgctggga

SEQ ID NO: 938 - DNA, 524 bp, Artificial
  TaSBEIIa-D allele with mutations introduced by TALEN pair TaSBEIIa_T01
  misc_feature (466): n is a or c or t or g
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaaaacgtaaaacggcttgtcccgcgtcatgcggcgaccgagttgctcttgcccggcgtttttcggagccatcttgactaccggtaatgcctacccgctgctttcgctcattttgaattaaggtccttcatcatgcaaatttgggaacatcaaagagncaaagactagggagccaccatttctacagatcccctcgtgtctgagaatatgctggga

SEQ ID NO: 939 - DNA, 428 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaattttcggagccatcttgactaccggtaatgcctacccgctgctttcgctcattttgaattaaggttcctttcatcatgcaaatttggggaacatcaaagagacaaagactagggacc

SEQ ID NO: 940 - DNA, 412 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactggcgggtgtcggggctggcttaactatgcggcatcagagcagattgtactgagagtgcaccattttcggagccatcttgactaccggtaatgcctacccgctgc

SEQ ID NO: 941 - DNA, 471 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagataccctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggg

SEQ ID NO: 942 - DNA, 474 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaaattaaggtcctttcatcatgcaaattttgggggaacatcaaagagacaaagactagggaccaccattttcatacagatcccctcgtggtctgagaatatgctggga

SEQ ID NO: 943 - DNA, 530 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgaaaacgtaaaacggcttgtcccgcgtcatgcggcgaccgagttgctcttgcccggcgtttttcggagccatcttgactaccggtaatgcctacccgctgctttcgctcattttgaattaaggtccttttcatcatgcaaaatttggggaacatcaaagagacaaagactagggaccaccatttcatacagatcccctcgtggtctgagaatatgctggga

SEQ ID NO: 944 - DNA, 524 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacatctccaggatacggtcctgggtgctgttccgggcgatctcgatcagctcgatgtactcgtgggggcaacggcgccgtgctgtccgtggaggagctcctgatcggcggcgagattttttcggagccatcttgactaccggtaatgcctacccgctgctttcgctcatttttcgaattaaggtcctttcatcatgcaaatttggggaactcaaatgg

SEQ ID NO: 945 - DNA, 470 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcacatgcaaatttggggaacatcaaagagacaaagactagggaccaccattttcatacagatcccctcgtggtctgagaatatgctggga

SEQ ID NO: 946 - DNA, 469 bp, Artificial
  TaSBEIIa-D allele with mutations introduced by TALEN pair TaSBEIIa_T01
agatggatgtgcattctagcaagaacttcacaacataaatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacacttcggagccatcttgactaccggtaatgcctacccgctgctttcgctcattttgaattaaggtcctttcatcatgcaaattttgggggaacatcaaagagacaaagactagggaccaccattttcatacagatcccctcgtggtctgagaatatgctggga

SEQ ID NO: 947 - DNA, 472 bp, Artificial; identical to SEQ ID NO: 704
  TaSBEIIa-D allele with mutations introduced by TALEN pair TaSBEIIa_T01

SEQ ID NO: 948 - DNA, 468 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcatcatgcaaatttggggaacatcaaagagacaaagactaggggaccaccattttcatacagatcccctcgtggtcctgagaatatgc

SEQ ID NO: 949 - DNA, 470 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactattttcggagccatcttgactaccggtaatgcctacccgctgctttcgctcattttgaattaaggtcctttcatcatgcaaatttggggaacatcaaagagacaaagactagggaccacccattttcatacagatcccctcgtggtctgagaatatgctggg

SEQ ID NO: 950 - DNA, 455 bp, Artificial
  TaSBEIIa-D allele with mutations introduced by TALEN pair TaSBEIIa_T01
agatggatgtgcattctagcaagaacttcacaacataaatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattttcatacagatccccctcgtgg

SEQ ID NO: 951 - DNA, 471 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttagggaactagtcgtgggggagaaaccgcgagttgtcccaaaaccaggagatggggcagaaaaatatacgagattgacccaacactgttcggagccatcttgactaccggtaatgcctacccgctgctttcgctcattttgaattaaggtcctttcatcatgcaaaattttgggggaacatcaaagagacaaagactagggaccaccattttcatacagatcccctcgtggtctgagaatatgctggga

SEQ ID NO: 952 - DNA, 466 bp, Artificial; identical to SEQ ID NO: 782
  TaSBEIIa-D allele with mutations introduced by TALEN pair TaSBEIIa_T01

SEQ ID NO: 953 - DNA, 470 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaacactgttttcggagccatcttgactaccggtaatgcctacccgctgctttcgctcatttttgaattaaggtcctttcatcatgcaaatttggggaacatcaaagagacaaagactagggaccaccattttcatacagatcccctcgtggtctgagaatatgctggga

SEQ ID NO: 954 - DNA, 468 bp, Artificial
  TaSBEIIa-D allele with mutations introduced by TALEN pair TaSBEIIa_T01
agatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtggggggagaaaccgcgagttgtcccaaaaccaggagatggggcagaaaaatatacgagattgaccccaacactgaggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 955 - DNA, 466 bp, Artificial
  TaSBEIIa-D allele with mutations introduced by TALEN pair TaSBEIIa_T01
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggggcagaaaaatatacgagattgacccaatttcggagccatcttgactaccggtaatgcctacccgctgcttttcgctcatttttgaattaaggtcctttcatcatgcaaatttggggaacatcaaagagacaaagactagggaccaccattttcatacagatcccctcgtggtctgagaatatgctggga

SEQ ID NO: 956 - DNA, 381 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaccaaaggagttaaggaactagtcgtggggaggaaaccgcgagttgtcccaaaaccaggagatgggcagaaaacatatacgagattgacccaacgctgaaagattttcggagccatcttgactaccggtaatgcctaccgctactttcgctcattttgaattaaggtccttcgtcatgcaaatttgggaacatcaaagagacaaagactagggaccactatttcttacagttccctcatggtctgagaatat

SEQ ID NO: 957 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 958 - DNA, 385 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaccaaaggagttaaggaactagtcgtggggagaaaaccgcgagttgtcccaaaaccaggagatgggcagaaaacatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttccctcatggtctgagaatatgc

SEQ ID NO: 959 - DNA, 465 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 960 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggaccgcagagaaacttgaatcttcagaaccgactcagggcattgaacaatcactgatggtgtaaccaaaggagttaaggaactagtcgcgggggagaaaccgcgagttgtcccaaaaccaggagatggggcagaaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 961 - DNA, 458 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccgagtaatgcctacccgctactttcgctcattttgaattaaggtcctttcgtcatgcaaatttggggaacatcaaagagacaaagactagggaccactatttcttacagttcccctcatggtctgag

SEQ ID NO: 962 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcaacaacactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 963 - DNA, 467 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 964 - DNA, 544 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgcgaggtggtcgttggtcaacgcggccaacgccggatcaggcgcgtcagcgggtgttggcgggtgtcggggctggctaaacaatcactgatggtgtaaccaaaggagttaaggaactagtcgtggggagaaaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 965 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcatcaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 966 - DNA, 466 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcaatgcatgacaacagatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 967 - DNA, 383 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaagagacaaagactagggaccactatttcttacagttcccctcatggtctgagaatatgc

SEQ ID NO: 968 - DNA, 384 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgc

SEQ ID NO: 969 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcatatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 970 - DNA, 416 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcataaacaatcactgatggtgtaaccaaaggagttaaggaactagtcgtgggggagaaaccgcgagttgtcccaaaaccaggagatggggcagaaaaatatgacagagattgacccaacgcctgaaagaattttcggatgccatcttgactaccggtaatgcctacccgctactttcgctcattttgaattaaggtcctttcgtcatgcaaatttggggaacatcaaagagac

SEQ ID NO: 971 - DNA, 384 bp, Artificial; identical to SEQ ID NO: 968
  TaSBEIIa-A allele with mutations introduced by TALEN pair TaSBEIIa_T02

SEQ ID NO: 972 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcatcatgcaaatttggggaacatcaaagagacaaagactagggaccaccatttcatacagatcccctcgtggtctgagaatatgctggga

SEQ ID NO: 973 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcaaacaacactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 974 - DNA, 465 bp, Artificial; identical to SEQ ID NO: 959
  TaSBEIIa-A allele with mutations introduced by TALEN pair TaSBEIIa_T02

SEQ ID NO: 975 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 976 - DNA, 519 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatcttgagatcctttttttctgctgcgtaatctgctgcttgcaaacaaaaaaccaccgaacaatcactgatggtgtaaccaaaggagttaaaggaactagtcgtgggggagaaaccgcggagttgtcccaaaaccaggagatgggcaagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 977 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 978 - DNA, 440 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcaattctagaacctgactcaagcatgacaatcactgatggtgtaaccaaaggagttaaggaactagtcgtgggggagaaaccgcgagttgtcccaaaaccaaggagatggggcagaaaaatatgacagagattgacccaatcgcctgaaagaatttttcggatgccatccttgtactaccggtcgaaatgccctaccccgctacttttcgctcattttgaattaaggtcctttcgtcatgcaaatttggggaacatcaaagagacaaagactagggga

SEQ ID NO: 979 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcatacaatcactgatggtgtaaccaaaggagttaaggaactagtcgtgggggagaaaccgcgagttggtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 980 - DNA, 532 bp, Artificial
  TaSBEIIa-A allele with mutations introduced by TALEN pair TaSBEIIa_T02
agatggatgtgcattctagcaagaacttcacaaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgttctccgctcatgatcattggatctagatgcattcgcgaggtaccgagctcgaattcactggccgtcaatcactgatggtgtaaccaaaggagttaaggaactagtcgtggggagaaaccgcgagttgtcccaaaaccaggagaatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 981 - DNA, 517 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgtgcacatcgttgcgttaagccaacacccggcagcgttagggaccgtcgctgtcaagtatcaacaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctacttcgctcatttgaattaaggtcctttcgtcatgcaaatttggggaacatcaaagagacaaagactagggaccactatttcttacagttcccctcatggtctgagaatat

SEQ ID NO: 982 - DNA, 418 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcaaacaaacactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagacta

SEQ ID NO: 983 - DNA, 400 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaacttgaatcttcagaaccgactcaaggcaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttgggaacatcaaagagacaaagactagggaccactatttcttacagttcccctcatggtctgagaatatgc

SEQ ID NO: 984 - DNA, 440 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctactttcgctcattttgaattaaggtcctttcgtcatgcaaatttggggaacatcaaagagacaaagactagggaccactattttcttacagtt

SEQ ID NO: 985 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcatacaatcactgatggtgtaaccaaaggagttaaggaactagtcgtgggggagaaaccgcgagttgtcccaaaaccaggagatggggcagaaaaatatgacagagattgacccaatcgcctgaaagaattttcggatgccatcttgactaccggtaatgcctacccgctactttcgctcattttgaattaaggtcctttcgtcatgcaaatttggggaacatcaaagagacaaagactaggggaccactatttcttacagttcccctcatggtctgag

SEQ ID NO: 986 - DNA, 460 bp, Artificial; identical to SEQ ID NO: 969
  TaSBEIIa-A allele with mutations introduced by TALEN pair TaSBEIIa_T02

SEQ ID NO: 987 - DNA, 384 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcatacagttcccctcatggtctgagaatatgc

SEQ ID NO: 988 - DNA, 513 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggtagcttccgccgcctgcgcttccagcaattccgactcttcaataacaatcactgatggtgtaaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcatcatgcaaatttggggaacatcaaagagacaaagactagggaccaccatttcatacagatcccctcgtggtctgagaatatgctggga

SEQ ID NO: 989 - DNA, 474 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaacctgactcaaggcaatgcatgacaacacgtagatggtgtaaccaaaggagttaaggaactagtcgtgggggagaaaccgcagagttgtcccaaaaccaggagatggggcagaaaaatatacgagattgacccaacgctgaaagaattttcggatgccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 990 - DNA, 459 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 991 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcaaacaaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 992 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatcatgacaactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 993 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 994 - DNA, 465 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 995 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcatacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 996 - DNA, 459 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaacaatcactgatggtgtaaccaaaggagttaaggaactagtcgtgggggagaaaccgcgagttgtcccaaaaccaggagatggcagaaaatatacgagattgacccaacgctgaaagattttcggagccatcttgactaccggtaatggcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 997 - DNA, 465 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcaaagcaacactgatggtgtaaccaaaggagttaaggaactagtcgtggggggaggaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 998 - DNA, 467 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgagaacaatcactgatggtgtaaccaaaggagttaaggaactagtcgtgggggagaaaccgcgagttgtcccaaaaccaggagatggggcgaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 999 - DNA, 512 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattggactccccgtcgtgtagataactacgatacgggagggcttaccatctggcctaaacaatcactgatggtgtaaccaaggagttaaggaactagtcgtggggagaaaccgcgagttgtccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaata

SEQ ID NO: 1000 - DNA, 476 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgacaatcactgatggtgtaaccaaaggagttaaggaactagtcgtgggggagaaaccgcgagttggtcccaaaaccaggagatggggcagaaaaatatgacagagattgacccaatcgcctgaaagaatttttcggatgccatcttgactaccggtcaatgcctacccgctactttcgctcattttgaattaaggtcctttcgtcatgcaaatttggggaacatcaaagagacaaagactaggggaccactattttcttacagttcccctcatggtctgagaatatgct

SEQ ID NO: 1001 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcattcagaaccgactcaaggcattaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1002 - DNA, 463 bp, Artificial; identical to SEQ ID NO: 993
  TaSBEIIa-A allele with mutations introduced by TALEN pair TaSBEIIa_T02

SEQ ID NO: 1003 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1004 - DNA, 469 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgcaatcactgatggtgtaaccaaaggagttaaggaactagtcgtgggggagaaaccgcgagttgtcccaaaaccaggagatggggcagaaaaatatacgagattgacccaacgcctgaaagaatttttcggatgccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgct

SEQ ID NO: 1005 - DNA, 465 bp, Artificial
  TaSBEIIa-A allele with mutations introduced by TALEN pair TaSBEIIa_T02
  misc_feature (186): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatgngaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1006 - DNA, 471 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaaggacatcgaggagcaaacggctgaagtaaacatgacagggggacgtgcagaaaacttgaatcattcagaacctgactcaaggcattgacaatcactgatggtgtaaccaaaggagttaaggaactagtcgtgggggagaaaccgcgagttggtcccaaaaccaggagatggggcagaaaaatatacgagattgacccaacgctgaaagaattttcggatgccatcttgactaccggtaatgcctacccgctactttcgctcattttgaattaaggtcctttcgtcatgcaaatttggggaacatcaaagagacaaaagactaggggaccactatttcttacagttcccctcatggtctgagaatatgct

SEQ ID NO: 1007 - DNA, 456 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1008 - DNA, 524 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgcccagctggtgaagtccgagctggaggagaagaaatccgagttgaggcacaagctgaagtacgtgccccacgagttggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1009 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcatttatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1010 - DNA, 464 bp, Artificial
  TaSBEIIa-A allele with mutations introduced by TALEN pair TaSBEIIa_T02
  misc_feature (196): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaatgcatgacaacngatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1011 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattcaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1012 - DNA, 384 bp, Artificial; identical to SEQ ID NO: 968
  TaSBEIIa-A allele with mutations introduced by TALEN pair TaSBEIIa_T02

SEQ ID NO: 1013 - DNA, 471 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcatcatgcaaatttggggaacatcaaagagacaaagactagggaccaccatttcatacagatcccctcgtggtctgagaatatgctggga

SEQ ID NO: 1014 - DNA, 462 bp, Artificial; identical to SEQ ID NO: 965
  TaSBEIIa-A allele with mutations introduced by TALEN pair TaSBEIIa_T02

SEQ ID NO: 1015 - DNA, 505 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattggactccccgtcgtgtagataactacgatacgggagggcttaccatctggcctaaacaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctga

SEQ ID NO: 1016 - DNA, 457 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcatcatgcaaatttggggaacatcaaagagacaaagactagggaccaccattttcatacagatcccctcgtggtctgagaatatgctggga

SEQ ID NO: 1017 - DNA, 466 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgagaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1018 - DNA, 403 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgc

SEQ ID NO: 1019 - DNA, 465 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1020 - DNA, 453 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1021 - DNA, 514 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattggactccccgtcgtgtagataactacgatacggggagggcttaccatctggcctaaacaatcactgatggtgtaaccaaaggagttaaggaactagtcgtggggagaaccggcgagttgtccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcctacaagttcccctcatggtctgagaatat

SEQ ID NO: 1022 - DNA, 467 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccaccatttcatacagatcccctcgtggtctgagaatatgctggga

SEQ ID NO: 1023 - DNA, 458 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaatcactgatggtgtaaccaaaggagttaaggaactagtcgtggggagaaaccgcgagttgtcccaaaaccaggagatgggcagaaatatacgagattgacccaacgcctgaaagattttcggaagtccatctgactaccggtaatgctacccgctactttcgctcattttgaattaaggtcctttcgtcatgcaaatttggggaacatcaaagagacaaagactagggaccactattttcttacagttcccctcatggtctgagaatatgctgga

SEQ ID NO: 1024 - DNA, 494 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaaggatcttcacctagatccttttaaattaaaaatgcaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactggggaccactatttcttacagttcccctcatggtctgagaatatgct

SEQ ID NO: 1025 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgcctgaaagattttcggaagtccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1026 - DNA, 463 bp, Artificial; identical to SEQ ID NO: 993
  TaSBEIIa-A allele with mutations introduced by TALEN pair TaSBEIIa_T02

SEQ ID NO: 1027 - DNA, 468 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgagaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1028 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcattcagaaccgactcaaggcattcaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1029 - DNA, 463 bp, Artificial; identical to SEQ ID NO: 993
  TaSBEIIa-A allele with mutations introduced by TALEN pair TaSBEIIa_T02

SEQ ID NO: 1030 - DNA, 458 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaattgc

SEQ ID NO: 1031 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaaaacaaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1032 - DNA, 457 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1033 - DNA, 385 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgc

SEQ ID NO: 1034 - DNA, 454 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctggga

SEQ ID NO: 1035 - DNA, 461 bp, Artificial; identical to SEQ ID NO: 1011
  TaSBEIIa-A allele with mutations introduced by TALEN pair TaSBEIIa_T02

SEQ ID NO: 1036 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattcaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1037 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatcactgatggtgtaaccaaaggagttaaggaactagtcgtgggggagaaaccgcgagttgtcccaaaaccaggagatgggcagaaaatatacgagattgacccaacgcctgaaagattttcggaagtccatcttgactaccggtaatggcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 1038 - DNA, 463 bp, Artificial
  TaSBEIIa-A allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagacatcgaggagcaaacggctgaagtaaacatgacagggggactgcagaaaaacttgaatcttcagaaccgactcaaggcattgacaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1039 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcaaacaaacactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1040 - DNA, 465 bp, Artificial; identical to SEQ ID NO: 959
  TaSBEIIa-A allele with mutations introduced by TALEN pair TaSBEIIa_T02

SEQ ID NO: 1041 - DNA, 464 bp, Artificial; identical to SEQ ID NO: 975
  TaSBEIIa-A allele with mutations introduced by TALEN pair TaSBEIIa_T02

SEQ ID NO: 1042 - DNA, 463 bp, Artificial; identical to SEQ ID NO: 993
  TaSBEIIa-A allele with mutations introduced by TALEN pair TaSBEIIa_T02

SEQ ID NO: 1043 - DNA, 459 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctatttcgtgctgtagatacctgaagacatcgaggagcaaacggctgaagtaaacatgacagggggactgcagaaaaacttgaatcttcagaaccgactcaaggcaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1044 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1045 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattctagaacctgactcaaggcaaacaacactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1046 - DNA, 523 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtgcacatcgttgcgttaagccaacacccggcagcgttagggaccgtcgctgtcaagtatcaacaatcactgatggtgtaaccaaaggagttaaggaactagtcgtggggagaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggg

SEQ ID NO: 1047 - DNA, 460 bp, Artificial; identical to SEQ ID NO: 977
  TaSBEIIa-A allele with mutations introduced by TALEN pair TaSBEIIa_T02

SEQ ID NO: 1048 - DNA, 458 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1049 - DNA, 432 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgc

SEQ ID NO: 1050 - DNA, 456 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1051 - DNA, 508 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggtagcttccgccgcctgcgcttccagcaattccgactcttcaataacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1052 - DNA, 460 bp, Artificial; identical to SEQ ID NO: 977
  TaSBEIIa-A allele with mutations introduced by TALEN pair TaSBEIIa_T02

SEQ ID NO: 1053 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattcatgacactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1054 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1055 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1056 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattcaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1057 - DNA, 463 bp, Artificial; identical to SEQ ID NO: 993
  TaSBEIIa-A allele with mutations introduced by TALEN pair TaSBEIIa_T02

SEQ ID NO: 1058 - DNA, 384 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgc

SEQ ID NO: 1059 - DNA, 459 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1060 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcatgaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1061 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaaaaacaaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1062 - DNA, 464 bp, Artificial; identical to SEQ ID NO: 1054
  TaSBEIIa-A allele with mutations introduced by TALEN pair TaSBEIIa_T02

SEQ ID NO: 1063 - DNA, 462 bp, Artificial
  TaSBEIIa-A allele with mutations introduced by TALEN pair TaSBEIIa_T02
  misc_feature (194): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaatcatgacacngatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1064 - DNA, 428 bp, Artificial
  TaSBEIIa-A allele with mutations introduced by TALEN pair TaSBEIIa_T02
  misc_feature (316): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagatggtgtaaccaaaggagttaaggaactagtcgtgggggagaaaccgcgagttgtcccaaaaccagggagatgggcagaaatatacgagattgacccaacgctgaaagattttcggagccatcttgactaccggtaatgctacccgcnactttcgctcatttgaattaaggtcctttcgtcatgcaatttgggaacatcaaagagacaaagactagggaccactatttcttacagttcccctcatggtctgagaatatgc

SEQ ID NO: 1065 - DNA, 458 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaacaatcactgatggtgtaaccaaaggagttaaggaactagtcgtgggggagaaaccgcgagttgtcccaaaaccaggagatgggcagaaaatatacgagattgacccaatgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1066 - DNA, 465 bp, Artificial
  TaSBEIIa-A allele with mutations introduced by TALEN pair TaSBEIIa_T02
agatggatgtgcattctagcaagaacttcacaaaataatgcactgtttgtggtttcgtttgtctgctctacaattgctattttcgtgctgtagatacctgaagacatcgaggagcaaacggctgaagtaaacatgacagggggactgcagaaaaacttgaatcttcagaaccgactcaaggcattgaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1067 - DNA, 458 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 1068 - DNA, 458 bp, Artificial; identical to SEQ ID NO: 1048
  TaSBEIIa-A allele with mutations introduced by TALEN pair TaSBEIIa_T02

SEQ ID NO: 1069 - DNA, 468 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattctagaacctgactcaaggcatgaaacaatcactgatggtgtaaccaaaggagttaaggaactagtcgtgggggagaaaccgcgagttgtcccaaaaccaggagatggggcagaaaaatatacgagattgacccaacgctgaaagaattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1070 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1071 - DNA, 467 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgagacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1072 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcatatcactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1073 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaaaacaatcactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1074 - DNA, 390 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactgagggaccactattttcttacagttcccctcatggtctgagaatatgctggg

SEQ ID NO: 1075 - DNA, 514 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattggactccccgtcgtgtagataactacgatacgggagggcttaccatctggcctaaacaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1076 - DNA, 463 bp, Artificial; identical to SEQ ID NO: 993
  TaSBEIIa-A allele with mutations introduced by TALEN pair TaSBEIIa_T02

SEQ ID NO: 1077 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcattcagaaccgactcaaggcaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1078 - DNA, 466 bp, Artificial; identical to SEQ ID NO: 1017
  TaSBEIIa-A allele with mutations introduced by TALEN pair TaSBEIIa_T02

SEQ ID NO: 1079 - DNA, 466 bp, Artificial; identical to SEQ ID NO: 1017
  TaSBEIIa-A allele with mutations introduced by TALEN pair TaSBEIIa_T02

SEQ ID NO: 1080 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattctagaacctgactcaaggcattgatcactgatggtgtaaccaaaggagttaaggaactagtcgtgggggagaaaccgcgagttggtcccaaaaccaaggagatggggcagaaaaatatacgagattgacccaacgctgaaagaatttttcggatgccatcttgactaccggtaatgcctacccgctactttcgctcattttgaattaaggtcctttcgtcatgcaaatttggggaacatcaaagagacaaaagactaggggaccactattttcttacagttcccctcatggtctgag

SEQ ID NO: 1081 - DNA, 455 bp, Artificial
  TaSBEIIa-A allele with mutations introduced by TALEN pair TaSBEIIa_T02
  misc_feature (195): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgatgacaacngatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgag

SEQ ID NO: 1082 - DNA, 461 bp, Artificial; identical to SEQ ID NO: 1011
  TaSBEIIa-A allele with mutations introduced by TALEN pair TaSBEIIa_T02

SEQ ID NO: 1083 - DNA, 430 bp, Artificial
  TaSBEIIa-A allele with mutations introduced by TALEN pair TaSBEIIa_T02
  misc_feature (198): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagatggtgtaccaaaaggagttaaggaactantcgtgggggagaaaccgcgagttgtccaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgc

SEQ ID NO: 1084 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcattcagaaccgactcaaggcattgatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1085 - DNA, 535 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacggtgcagaaaacttgaatcaattctagaacctgactcaaggcattggttctccgcctcatgatcattgatgctagatgcattcgcgaggtaccgagctcgaattcactggccgtcaatcactgatggtgtaaccaaaggagttaaggaactagtcgtggggagaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 1086 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1087 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcataacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1088 - DNA, 459 bp, Artificial; identical to SEQ ID NO: 990
  TaSBEIIa-A allele with mutations introduced by TALEN pair TaSBEIIa_T02

SEQ ID NO: 1089 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaacaatcactgatggtgtaaccaaaggagttaaggaactagtcgtgggggagaaaccgcgagttgtcccaaaaccaggagatgggcagaaaatatacgagattgacccaacgcctgaaagattttcggaagtccatcttgactaccggtaatgcctacccgctactttcgctcattttgaattaaggtcctttcgtcatgcaaatttggggaacatcaaagaacaaagactagggaccactattttcttacagttcccctcatggtctgagaatatgctggga

SEQ ID NO: 1090 - DNA, 460 bp, Artificial; identical to SEQ ID NO: 977
  TaSBEIIa-A allele with mutations introduced by TALEN pair TaSBEIIa_T02

SEQ ID NO: 1091 - DNA, 530 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgttctccgctcatgatcattggatctagatgcattcgcgaggtaccgagctcgaattcactggccgtcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 1092 - DNA, 530 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgttctccgctcatgatcattggatctagatgcattcgcgaggtaccgagctcgaattcactggccgtcaatcactgatggtgtaaccaaaggagttaaggaactagtcgtggggagaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 1093 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcattcagaaccgactcaaggcatacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1094 - DNA, 453 bp, Artificial; identical to SEQ ID NO: 1020
  TaSBEIIa-A allele with mutations introduced by TALEN pair TaSBEIIa_T02

SEQ ID NO: 1095 - DNA, 453 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcaattctagaacctgactcaaggcatggtgtacaaaaggagttaaggaactagtcgtgggggagaaaccgcgagttgtcccaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 1096 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1097 - DNA, 455 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1098 - DNA, 454 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1099 - DNA, 462 bp, Artificial; identical to SEQ ID NO: 1070
  TaSBEIIa-A allele with mutations introduced by TALEN pair TaSBEIIa_T02

SEQ ID NO: 1100 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcatcaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagaggcaaagactagggaccactatttcatacagttcccctcatggtctgagaatatgct

SEQ ID NO: 1101 - DNA, 454 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattggtgtaaccaaaggagttaaggaactagtcgtggggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1102 - DNA, 465 bp, Artificial; identical to SEQ ID NO: 994
  TaSBEIIa-A allele with mutations introduced by TALEN pair TaSBEIIa_T02

SEQ ID NO: 1103 - DNA, 453 bp, Artificial; identical to SEQ ID NO: 1020
  TaSBEIIa-A allele with mutations introduced by TALEN pair TaSBEIIa_T02

SEQ ID NO: 1104 - DNA, 462 bp, Artificial; identical to SEQ ID NO: 1028
  TaSBEIIa-A allele with mutations introduced by TALEN pair TaSBEIIa_T02

SEQ ID NO: 1105 - DNA, 466 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaagacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1106 - DNA, 457 bp, Artificial
  TaSBEIIa-A allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggactgcagaaaaacttgaatcttcagaaccgactcaaggcatacaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaata

SEQ ID NO: 1107 - DNA, 463 bp, Artificial; identical to SEQ ID NO: 993
  TaSBEIIa-A allele with mutations introduced by TALEN pair TaSBEIIa_T02

SEQ ID NO: 1108 - DNA, 382 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaccaaaggagttaaggaactagtcgtgggggagaaaccgcgagttgtcccaaaaccaggagatgggcagaaaatatacgagattgacccaacgctgaaagatttcggagcatcttgactaccggtaatgcctacccgctactttcgctcattttgaattaaggtcctttcgtcatgcaaatttgggaacatcaaagagacaaagactagggaccactatttcatacagttcccctcatggtctgagaatatgc

SEQ ID NO: 1109 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggaaacaatcactgatggtgtaaccaaaggagttaaggaactagtcgcgggggagaaaccgcgagttgtcccaaaaccaggagatggggcagaaaaatatacgagattgacccaacgctgaaagattttcggagccatcttgactaccggtaatgcctacccgctaattctgctcattttgaattaaggtcctttcatcatgcaaatttggggaacatcaaagaggcaaagactagggaccactatttcatacagttcccctcatggtctgagaatatgct

SEQ ID NO: 1110 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1111 - DNA, 465 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcatgacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgct

SEQ ID NO: 1112 - DNA, 464 bp, Artificial; identical to SEQ ID NO: 1054
  TaSBEIIa-A allele with mutations introduced by TALEN pair TaSBEIIa_T02

SEQ ID NO: 1113 - DNA, 431 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttc

SEQ ID NO: 1114 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatcaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1115 - DNA, 463 bp, Artificial; identical to SEQ ID NO: 993
  TaSBEIIa-A allele with mutations introduced by TALEN pair TaSBEIIa_T02

SEQ ID NO: 1116 - DNA, 463 bp, Artificial; identical to SEQ ID NO: 1055
  TaSBEIIa-A allele with mutations introduced by TALEN pair TaSBEIIa_T02

SEQ ID NO: 1117 - DNA, 467 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 1118 - DNA, 432 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtcttgagaatatgc

SEQ ID NO: 1119 - DNA, 468 bp, Artificial; identical to SEQ ID NO: 1027
  TaSBEIIa-A allele with mutations introduced by TALEN pair TaSBEIIa_T02

SEQ ID NO: 1120 - DNA, 463 bp, Artificial; identical to SEQ ID NO: 1055
  TaSBEIIa-A allele with mutations introduced by TALEN pair TaSBEIIa_T02

SEQ ID NO: 1121 - DNA, 459 bp, Artificial
  TaSBEIIa-A allele with mutations introduced by TALEN pair TaSBEIIa_T02
agatggatgtgcattctagcaagaacttcacaacataatgcaccgtttgggggtttcgtcagtctgctctacaattgctattttcgtgctgtagatacctgaagatatcgaggagcaaacggctgaagtaaacatgacagggggactgcagaaaaacttgaatcttcagaaccgactcaaggcatatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1122 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcaaacaacactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1123 - DNA, 462 bp, Artificial; identical to SEQ ID NO: 1070
  TaSBEIIa-A allele with mutations introduced by TALEN pair TaSBEIIa_T02

SEQ ID NO: 1124 - DNA, 465 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaacaatcactgatggtgtaaccaaaggagttaaggaactagtcggtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1125 - DNA, 455 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaaattaaggtcctttcgtcatgcaaatttggggaacatcaaagagacaaagactagggaccactattttcttacagttccccctcatggtctgagaatatgctggga

SEQ ID NO: 1126 - DNA, 467 bp, Artificial
  TaSBEIIa-A allele with mutations introduced by TALEN pair TaSBEIIa_T02
  misc_feature (188): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcatgngaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1127 - DNA, 463 bp, Artificial; identical to SEQ ID NO: 993
  TaSBEIIa-A allele with mutations introduced by TALEN pair TaSBEIIa_T02

SEQ ID NO: 1128 - DNA, 443 bp, Artificial
  TaSBEIIa-A allele with mutations introduced by TALEN pair TaSBEIIa_T02
  misc_feature (187); (198): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagatggtgtaaccaaaggngttaaggaacnagtcgtgggggagaaaccgcgagttgtccccaaaaccagggagaatggggcagaaaatataacgagattgacccaacgctgaaagattttcggagccatcttgactaccggtaatgcctacccgctactttcgctcattttgaattaaggtcctttcgtcatgcaatttgggaacatcaaagagacaaagactagggagccactatttcttacagttcccctcatggtctgagaattatgctggg

SEQ ID NO: 1129 - DNA, 463 bp, Artificial; identical to SEQ ID NO: 993
  TaSBEIIa-A allele with mutations introduced by TALEN pair TaSBEIIa_T02

SEQ ID NO: 1130 - DNA, 453 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttctcatgcaaatttggggaacatcaaagagacaaagactagggaccacattttcatacagatcccctcgtggtctgagaatatgctggga

SEQ ID NO: 1131 - DNA, 453 bp, Artificial; identical to SEQ ID NO: 1020
  TaSBEIIa-A allele with mutations introduced by TALEN pair TaSBEIIa_T02

SEQ ID NO: 1132 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1133 - DNA, 459 bp, Artificial; identical to SEQ ID NO: 990
  TaSBEIIa-A allele with mutations introduced by TALEN pair TaSBEIIa_T02

SEQ ID NO: 1134 - DNA, 465 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtatgagaatatgctggga

SEQ ID NO: 1135 - DNA, 487 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaaggatcttcacctagatccttttaaattaaaaaatgcaatcactgatggtgtaaccaaaggagttaaggaactagtcgtggggagaaaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctg

SEQ ID NO: 1136 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1137 - DNA, 462 bp, Artificial; identical to SEQ ID NO: 1086
  TaSBEIIa-A allele with mutations introduced by TALEN pair TaSBEIIa_T02

SEQ ID NO: 1138 - DNA, 431 bp, Artificial; identical to SEQ ID NO: 1113
  TaSBEIIa-A allele with mutations introduced by TALEN pair TaSBEIIa_T02

SEQ ID NO: 1139 - DNA, 463 bp, Artificial; identical to SEQ ID NO: 993
  TaSBEIIa-A allele with mutations introduced by TALEN pair TaSBEIIa_T02

SEQ ID NO: 1140 - DNA, 461 bp, Artificial; identical to SEQ ID NO: 1132
  TaSBEIIa-A allele with mutations introduced by TALEN pair TaSBEIIa_T02

SEQ ID NO: 1141 - DNA, 512 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtgcacatcgttgcgttaagccaacacccggcagcgttagggaccgtcgctgtcaagtatcaacaatcactgatggtgtaaccaaaggagttaaggaactagtcgtggggagaaaccgcgagttgtcccaaaaccaggagatgggcagaaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactatttcttacagttcccctcatggtctga

SEQ ID NO: 1142 - DNA, 453 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1143 - DNA, 466 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1144 - DNA, 463 bp, Artificial; identical to SEQ ID NO: 1055
  TaSBEIIa-A allele with mutations introduced by TALEN pair TaSBEIIa_T02

SEQ ID NO: 1145 - DNA, 510 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggtagcttccgccgcctgcgcttccagcaattccgactcttcaataacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1146 - DNA, 456 bp, Artificial; identical to SEQ ID NO: 1050
  TaSBEIIa-A allele with mutations introduced by TALEN pair TaSBEIIa_T02

SEQ ID NO: 1147 - DNA, 458 bp, Artificial; identical to SEQ ID NO: 1067
  TaSBEIIa-A allele with mutations introduced by TALEN pair TaSBEIIa_T02

SEQ ID NO: 1148 - DNA, 457 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 1149 - DNA, 465 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaacctgactcaaggcatcaatcactgatggtgtaaccaaaggagttaaggaactagtcgtgggggagaaaccgcgagttgtcccaaaaccaggagatggggcagaaaaatatacgagattgacccaacgctgaaagaattttcggagccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgct

SEQ ID NO: 1150 - DNA, 462 bp, Artificial; identical to SEQ ID NO: 1087
  TaSBEIIa-A allele with mutations introduced by TALEN pair TaSBEIIa_T02

SEQ ID NO: 1151 - DNA, 468 bp, Artificial; identical to SEQ ID NO: 1027
  TaSBEIIa-A allele with mutations introduced by TALEN pair TaSBEIIa_T02

SEQ ID NO: 1152 - DNA, 463 bp, Artificial; identical to SEQ ID NO: 993
  TaSBEIIa-A allele with mutations introduced by TALEN pair TaSBEIIa_T02

SEQ ID NO: 1153 - DNA, 464 bp, Artificial; identical to SEQ ID NO: 1054
  TaSBEIIa-A allele with mutations introduced by TALEN pair TaSBEIIa_T02

SEQ ID NO: 1154 - DNA, 464 bp, Artificial; identical to SEQ ID NO: 1054
  TaSBEIIa-A allele with mutations introduced by TALEN pair TaSBEIIa_T02

SEQ ID NO: 1155 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctaattctgctcattttgaattaaggtcctttcatcatagcaaatttggggaacatcaaagaggcaaagactagggaccactatttcttacagttcccctcatggtctgagaatatgct

SEQ ID NO: 1156 - DNA, 458 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaacaatcactgatggtgtaaccaaaggagttaaggaactagtcgtgggggagaaaccgcgagttgtcccaaaaccaggagatggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1157 - DNA, 463 bp, Artificial; identical to SEQ ID NO: 1055
  TaSBEIIa-A allele with mutations introduced by TALEN pair TaSBEIIa_T02

SEQ ID NO: 1158 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcatatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1159 - DNA, 460 bp, Artificial; identical to SEQ ID NO: 977
  TaSBEIIa-A allele with mutations introduced by TALEN pair TaSBEIIa_T02

SEQ ID NO: 1160 - DNA, 461 bp, Artificial; identical to SEQ ID NO: 1132
  TaSBEIIa-A allele with mutations introduced by TALEN pair TaSBEIIa_T02

SEQ ID NO: 1161 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatcaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgct

SEQ ID NO: 1162 - DNA, 457 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctggga

SEQ ID NO: 1163 - DNA, 460 bp, Artificial; identical to SEQ ID NO: 1114
  TaSBEIIa-A allele with mutations introduced by TALEN pair TaSBEIIa_T02

SEQ ID NO: 1164 - DNA, 461 bp, Artificial; identical to SEQ ID NO: 1096
  TaSBEIIa-A allele with mutations introduced by TALEN pair TaSBEIIa_T02

SEQ ID NO: 1165 - DNA, 516 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtgcacatcgttgcgttaagccaacacccggcagcgttagggaccgtcgctgtcaagtatcaacaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactatttcttacagttcccctcatggtctgagaa

SEQ ID NO: 1166 - DNA, 516 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcattcagaaccgactcaaggcattggactccccgtcgtgtagataactacgatacgggagggcttaccatctggcctaaacaatcactgatggtgtaaccaaaaggagttaaggaactagtcgtgggggagaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1167 - DNA, 464 bp, Artificial; identical to SEQ ID NO: 1054
  TaSBEIIa-A allele with mutations introduced by TALEN pair TaSBEIIa_T02

SEQ ID NO: 1168 - DNA, 465 bp, Artificial; identical to SEQ ID NO: 994
  TaSBEIIa-A allele with mutations introduced by TALEN pair TaSBEIIa_T02

SEQ ID NO: 1169 - DNA, 464 bp, Artificial
  TaSBEIIa-A allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtaaacatgacaggggggactgcagaaaaacttgaatcttcagaaccgactcaaggcaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1170 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1171 - DNA, 460 bp, Artificial; identical to SEQ ID NO: 977
  TaSBEIIa-A allele with mutations introduced by TALEN pair TaSBEIIa_T02

SEQ ID NO: 1172 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaaaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1173 - DNA, 463 bp, Artificial; identical to SEQ ID NO: 1036
  TaSBEIIa-A allele with mutations introduced by TALEN pair TaSBEIIa_T02

SEQ ID NO: 1174 - DNA, 466 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattgcaatcactgatggtgtaaccaaaggagttaaggaactagtcgtgggggagaaaccgcgagttggtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgct

SEQ ID NO: 1175 - DNA, 382 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttgggaacatcaagagacaaagactagggaccactatttcttacagttcccctcatggtctgagaatatgc

SEQ ID NO: 1176 - DNA, 458 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1177 - DNA, 458 bp, Artificial; identical to SEQ ID NO: 1048
  TaSBEIIa-A allele with mutations introduced by TALEN pair TaSBEIIa_T02

SEQ ID NO: 1178 - DNA, 468 bp, Artificial; identical to SEQ ID NO: 1027
  TaSBEIIa-A allele with mutations introduced by TALEN pair TaSBEIIa_T02

SEQ ID NO: 1179 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcactgatggtgtaaccaaaggagttaaggaactagtcgtggggggagaaaccgcgagttgtcccaaaaaccaggagatggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctggga

SEQ ID NO: 1180 - DNA, 472 bp, Artificial
  TaSBEIIa-A allele with mutations introduced by TALEN pair TaSBEIIa_T02
  misc_feature (333): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattcaatcactgatggtgtaaccaaaggagttaaggaactagtcgtgggggagaaaccgcgagttgtcccaaaaccaggagatggggcagaaaaatatacgatgattcgacccaacgcctgaaagaatttttcggatgccatcttgacnaccggtaatgcctacccgctactttcgctcattttgaattaaggtcctttcgtcatgcaaatttggggaacatcaaagagacaaagactagggaccactattttcttacagtttccccctcatggtctgagaatatgct

SEQ ID NO: 1181 - DNA, 463 bp, Artificial
  TaSBEIIa-A allele with mutations introduced by TALEN pair TaSBEIIa_T02
  misc_feature (195): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaatcatgacaacngatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1182 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgcaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1183 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaacaatcactgatggtgtaaccaaaggagttaaggaactagtcgtgggggagaaaccgcgagttgtcccaaaaccaggagatgggcagaaaatatacgagattgacccaacgcctgaaagattttcggagtccatctgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1184 - DNA, 456 bp, Artificial; identical to SEQ ID NO: 1050
  TaSBEIIa-A allele with mutations introduced by TALEN pair TaSBEIIa_T02

SEQ ID NO: 1185 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattagacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1186 - DNA, 385 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcatacagttcccctcatggtctgagaatatgc

SEQ ID NO: 1187 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgcaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1188 - DNA, 493 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaaggatctttcacctagatccttttaaattaaaaatgcaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatg

SEQ ID NO: 1189 - DNA, 464 bp, Artificial; identical to SEQ ID NO: 1054
  TaSBEIIa-A allele with mutations introduced by TALEN pair TaSBEIIa_T02

SEQ ID NO: 1190 - DNA, 466 bp, Artificial; identical to SEQ ID NO: 1143
  TaSBEIIa-A allele with mutations introduced by TALEN pair TaSBEIIa_T02

SEQ ID NO: 1191 - DNA, 460 bp, Artificial; identical to SEQ ID NO: 1044
  TaSBEIIa-A allele with mutations introduced by TALEN pair TaSBEIIa_T02

SEQ ID NO: 1192 - DNA, 460 bp, Artificial; identical to SEQ ID NO: 1136
  TaSBEIIa-A allele with mutations introduced by TALEN pair TaSBEIIa_T02

SEQ ID NO: 1193 - DNA, 464 bp, Artificial; identical to SEQ ID NO: 1169
  TaSBEIIa-A allele with mutations introduced by TALEN pair TaSBEIIa_T02

SEQ ID NO: 1194 - DNA, 457 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcactgatggtggtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1195 - DNA, 512 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattggactccccgtcgtgtagataactacgatacgggagggcttaccatctggcctaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatat

SEQ ID NO: 1196 - DNA, 814 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaaagccgctggaccgtctccagcgcctgcttgccaccgccattgctggcgatggccaccacctgctgggggggtcaagccgtgggcctggcacagcaccggcaacagcgcctgcaccgtctccagcgcctgcttgccaccaatattgctggcgatggccaccacctgctccggggtcaagccgtgggcctggcacagcaccggcaacagccgctggagacgagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacgcaatcactgtggtgtaaccaaagggttaagaactagtcgtggggggagaaaaccgcgagttgtcccaaaaccggagatggggcagaaaataatacgagattgacccaacgctgaaagattttcggagccaatcttgactaccggtaaatgcctacccgcactttcgctcatttgaattaaggtcctttcgtcatgcaaatttggggaactcaaaagagacaaagactagggaccactattcttacagttcccctcatggtctgag

SEQ ID NO: 1197 - DNA, 462 bp, Artificial; identical to SEQ ID NO: 1070
  TaSBEIIa-A allele with mutations introduced by TALEN pair TaSBEIIa_T02

SEQ ID NO: 1198 - DNA, 462 bp, Artificial; identical to SEQ ID NO: 1086
  TaSBEIIa-A allele with mutations introduced by TALEN pair TaSBEIIa_T02

SEQ ID NO: 1199 - DNA, 465 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcattcagaaccgactcaaggcattgaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1200 - DNA, 459 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1201 - DNA, 462 bp, Artificial
  TaSBEIIa-A allele with mutations introduced by TALEN pair TaSBEIIa_T02
  misc_feature (194); (195); (196): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtgaacacnnntggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1202 - DNA, 461 bp, Artificial; identical to SEQ ID NO: 1096
  TaSBEIIa-A allele with mutations introduced by TALEN pair TaSBEIIa_T02

SEQ ID NO: 1203 - DNA, 454 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggacgtgcagaaacttgaatcaattctagaacctgactcagcatgatgtgtaaccaaaggagttaaggaactagtcgtgggggagaaaccgcgagttgtcccaaaaccaggagatggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctggga

SEQ ID NO: 1204 - DNA, 460 bp, Artificial; identical to SEQ ID NO: 1114
  TaSBEIIa-A allele with mutations introduced by TALEN pair TaSBEIIa_T02

SEQ ID NO: 1205 - DNA, 463 bp, Artificial; identical to SEQ ID NO: 993
  TaSBEIIa-A allele with mutations introduced by TALEN pair TaSBEIIa_T02

SEQ ID NO: 1206 - DNA, 465 bp, Artificial; identical to SEQ ID NO: 994
  TaSBEIIa-A allele with mutations introduced by TALEN pair TaSBEIIa_T02

SEQ ID NO: 1207 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatagacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1208 - DNA, 384 bp, Artificial; identical to SEQ ID NO: 968
  TaSBEIIa-A allele with mutations introduced by TALEN pair TaSBEIIa_T02

SEQ ID NO: 1209 - DNA, 459 bp, Artificial; identical to SEQ ID NO: 990
  TaSBEIIa-A allele with mutations introduced by TALEN pair TaSBEIIa_T02

SEQ ID NO: 1210 - DNA, 491 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaaggatcttcacctagatccttttaaattaaaaatgcaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttccccctcatggtctgagaat

SEQ ID NO: 1211 - DNA, 461 bp, Artificial; identical to SEQ ID NO: 1096
  TaSBEIIa-A allele with mutations introduced by TALEN pair TaSBEIIa_T02

SEQ ID NO: 1212 - DNA, 462 bp, Artificial; identical to SEQ ID NO: 1087
  TaSBEIIa-A allele with mutations introduced by TALEN pair TaSBEIIa_T02

SEQ ID NO: 1213 - DNA, 458 bp, Artificial
  TaSBEIIa-A allele with mutations introduced by TALEN pair TaSBEIIa_T02
agatggatgtgcattctagcaagaacttcacaaaataatgcactgtttgtggtttcgtttgtctgctctacgattgctatttttcgtgctgtagatacctgaagacatcgaggagcaaacggctgaagtaaacatgacagggggactgcagaaaaacttgaatcttcagaaccgactcaaggcatcaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1214 - DNA, 511 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggtagcttccgccgcctgcgcttccagcaattccgactcttcaataacaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaaagagacaaaagactagggaccactatttcttacagttcccctcatggtctgagaatatgct

SEQ ID NO: 1215 - DNA, 461 bp, Artificial; identical to SEQ ID NO: 1011
  TaSBEIIa-A allele with mutations introduced by TALEN pair TaSBEIIa_T02

SEQ ID NO: 1216 - DNA, 466 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccaccatttcatacagatcccctcgtggtctgagaatatgctggga

SEQ ID NO: 1217 - DNA, 385 bp, Artificial; identical to SEQ ID NO: 1033
  TaSBEIIa-A allele with mutations introduced by TALEN pair TaSBEIIa_T02

SEQ ID NO: 1218 - DNA, 464 bp, Artificial
  TaSBEIIa-A allele with mutations introduced by TALEN pair TaSBEIIa_T02
  misc_feature (70): n is a or c or t or g
agatggatgtgcattctagcaagaacttcacaaaataatgcactgtttgtggtttcgtttgtctgctctncgattgctatttttcgtgtgctgtagatacctgaagatatcgaggagcaaacggctgaagtaaacatgacaggggggactgcagaaaaacttgaatcttcagaaccgactcaaggcaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1219 - DNA, 517 bp, Artificial
  TaSBEIIa-A allele with mutations introduced by TALEN pair TaSBEIIa_T02
  misc_feature (288): n is a or c or t or g
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtgggtcggaacaggagagcgcacgagggagcttccagggggaaacgcctggtaaacaatcactgatggtgtaaccaaaggagttaaggaactagtcgnggggagaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1220 - DNA, 463 bp, Artificial; identical to SEQ ID NO: 1055
  TaSBEIIa-A allele with mutations introduced by TALEN pair TaSBEIIa_T02

SEQ ID NO: 1221 - DNA, 468 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1222 - DNA, 463 bp, Artificial; identical to SEQ ID NO: 1055
  TaSBEIIa-A allele with mutations introduced by TALEN pair TaSBEIIa_T02

SEQ ID NO: 1223 - DNA, 459 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagaggcaaagactagggaccactatttcatacagttcccctcatggtctgagaatatgct

SEQ ID NO: 1224 - DNA, 458 bp, Artificial; identical to SEQ ID NO: 1176
  TaSBEIIa-A allele with mutations introduced by TALEN pair TaSBEIIa_T02

SEQ ID NO: 1225 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaaacggctgaagtaaacatgacagggggactgcagaaaaacttgaatcttcagaaccgactcaaggcaaaacaaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1226 - DNA, 464 bp, Artificial; identical to SEQ ID NO: 1054
  TaSBEIIa-A allele with mutations introduced by TALEN pair TaSBEIIa_T02

SEQ ID NO: 1227 - DNA, 461 bp, Artificial; identical to SEQ ID NO: 1096
  TaSBEIIa-A allele with mutations introduced by TALEN pair TaSBEIIa_T02

SEQ ID NO: 1228 - DNA, 460 bp, Artificial; identical to SEQ ID NO: 1136
  TaSBEIIa-A allele with mutations introduced by TALEN pair TaSBEIIa_T02

SEQ ID NO: 1229 - DNA, 462 bp, Artificial
  TaSBEIIa-A allele with mutations introduced by TALEN pair TaSBEIIa_T02
  misc_feature (194): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgatgacacngatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1230 - DNA, 456 bp, Artificial; identical to SEQ ID NO: 1050
  TaSBEIIa-A allele with mutations introduced by TALEN pair TaSBEIIa_T02

SEQ ID NO: 1231 - DNA, 453 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgag

SEQ ID NO: 1232 - DNA, 458 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgagaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgag

SEQ ID NO: 1233 - DNA, 462 bp, Artificial; identical to SEQ ID NO: 1070
  TaSBEIIa-A allele with mutations introduced by TALEN pair TaSBEIIa_T02

SEQ ID NO: 1234 - DNA, 463 bp, Artificial; identical to SEQ ID NO: 1055
  TaSBEIIa-A allele with mutations introduced by TALEN pair TaSBEIIa_T02

SEQ ID NO: 1235 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcaaacaacactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1236 - DNA, 459 bp, Artificial; identical to SEQ ID NO: 990
  TaSBEIIa-A allele with mutations introduced by TALEN pair TaSBEIIa_T02

SEQ ID NO: 1237 - DNA, 498 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaaggatcttcacctagatccttttaaattaaaaatgcaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccaccatttcatacagatcccctcgtggtctgagaatatgctggga

SEQ ID NO: 1238 - DNA, 453 bp, Artificial; identical to SEQ ID NO: 1020
  TaSBEIIa-A allele with mutations introduced by TALEN pair TaSBEIIa_T02

SEQ ID NO: 1239 - DNA, 461 bp, Artificial; identical to SEQ ID NO: 1096
  TaSBEIIa-A allele with mutations introduced by TALEN pair TaSBEIIa_T02

SEQ ID NO: 1240 - DNA, 462 bp, Artificial
  TaSBEIIa-A allele with mutations introduced by TALEN pair TaSBEIIa_T02
agatggatgtgcattctagcaagaacttcacgaaataatgcactgttttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1241 - DNA, 463 bp, Artificial; identical to SEQ ID NO: 993
  TaSBEIIa-A allele with mutations introduced by TALEN pair TaSBEIIa_T02

SEQ ID NO: 1242 - DNA, 532 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgttctccgctcatgatcattggatctagatgcattcgcgaggtaccgagctcgaattcactggccgtcaatcactgatggtgtaaccaaaggagttaaggaactagtcgtggggagaaaccgcgagttgtcccaaaaccaggagatgggcagaaaaatatacgagattgacccaaacgctgaaagattttcggagccatcttgactaccgggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 1243 - DNA, 466 bp, Artificial; identical to SEQ ID NO: 1017
  TaSBEIIa-A allele with mutations introduced by TALEN pair TaSBEIIa_T02

SEQ ID NO: 1244 - DNA, 384 bp, Artificial; identical to SEQ ID NO: 968
  TaSBEIIa-A allele with mutations introduced by TALEN pair TaSBEIIa_T02

SEQ ID NO: 1245 - DNA, 465 bp, Artificial
  TaSBEIIa-A allele with mutations introduced by TALEN pair TaSBEIIa_T02
agatggatgtgcattctagcaagaacttcacaacataatgcaccgtttgggggtttcgttagtctgctctacaattgctattttcgtgctgtagatacctgaagacatcgaggagcaaacggctgaagtaaacatgacagggggactgcagaaaaacttgaatcttcagaaccgactcaaggcattgaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1246 - DNA, 466 bp, Artificial; identical to SEQ ID NO: 1017
  TaSBEIIa-A allele with mutations introduced by TALEN pair TaSBEIIa_T02

SEQ ID NO: 1247 - DNA, 464 bp, Artificial; identical to SEQ ID NO: 1054
  TaSBEIIa-A allele with mutations introduced by TALEN pair TaSBEIIa_T02

SEQ ID NO: 1248 - DNA, 470 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattggactccccgtcgtgtagataactacgatacgggagggcttaccatctggcctaaacaatcactgatggtgtaaccaaaggagttaaggaactagtcgtggggagaaaccgcgagttgtccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagacta

SEQ ID NO: 1249 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaacaatcactgatggtgtaaccaaaggagttaaggaactagtcgtgggggagaaaccgcgagttgtcccaaaaccaggagatgggcagaaaatatacgagattgacccaacgctgaaagattttcggaagtccatcttgactaccggtaatggcctacccgctactttcgctcattttgaattaaggtcctttcgtcatgcaaatttggggaacatcaaagagacaaagactagggaccactattttcttacagttcccctcatggtctgagaatatgctgga

SEQ ID NO: 1250 - DNA, 526 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgcccagctggtgaagtccgagctggaggagaagaaatccgagttgaggcacaagctgaagtacgtgccccacgagttggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctgg

SEQ ID NO: 1251 - DNA, 461 bp, Artificial; identical to SEQ ID NO: 1132
  TaSBEIIa-A allele with mutations introduced by TALEN pair TaSBEIIa_T02

SEQ ID NO: 1252 - DNA, 385 bp, Artificial; identical to SEQ ID NO: 1033
  TaSBEIIa-A allele with mutations introduced by TALEN pair TaSBEIIa_T02

SEQ ID NO: 1253 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaacttgaatcttcagaaccgactcaaacaatcactgatggtgtaaccaaaggagttaaggaactagtcgtgggggagaaaccgcgagttgtcccaaaaccaggagatgggcagaaaatatacgagatttgacccaacgcctgaaagattttcggaagtccatctgactaccggtaatggcctacccgctactttcgctcattttgaattaaggtcctttcgtcatgcaaatttggggaacatcaaagagacaaagactagggaccactatttcttacagttcccctcatggtctgagaatatgctgggaa

SEQ ID NO: 1254 - DNA, 463 bp, Artificial; identical to SEQ ID NO: 993
  TaSBEIIa-A allele with mutations introduced by TALEN pair TaSBEIIa_T02

SEQ ID NO: 1255 - DNA, 461 bp, Artificial; identical to SEQ ID NO: 1096
  TaSBEIIa-A allele with mutations introduced by TALEN pair TaSBEIIa_T02

SEQ ID NO: 1256 - DNA, 459 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatggcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1257 - DNA, 462 bp, Artificial; identical to SEQ ID NO: 1187
  TaSBEIIa-A allele with mutations introduced by TALEN pair TaSBEIIa_T02

SEQ ID NO: 1258 - DNA, 463 bp, Artificial; identical to SEQ ID NO: 1055
  TaSBEIIa-A allele with mutations introduced by TALEN pair TaSBEIIa_T02

SEQ ID NO: 1259 - DNA, 508 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggtagcttccgccgcctgcgcttccagcaattccgactcttcaataacaatcactaatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1260 - DNA, 464 bp, Artificial
  TaSBEIIa-A allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaaggcatgaacatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccccctcatggtctgagaatatgct

SEQ ID NO: 1261 - DNA, 520 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgttctccgctcatgatcattggatctagatgcattcgcgaggtaccgagctcgaattcactggccgtcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactacggtaatgcctacccgctactttcgctcatttgaattaaggtccttcgtcatgcaatttgggaacatcaagagacaagactagggaccactatttcttacagttcccctcatggtctgagaagtatgct

SEQ ID NO: 1262 - DNA, 463 bp, Artificial; identical to SEQ ID NO: 993
  TaSBEIIa-A allele with mutations introduced by TALEN pair TaSBEIIa_T02

SEQ ID NO: 1263 - DNA, 458 bp, Artificial; identical to SEQ ID NO: 1048
  TaSBEIIa-A allele with mutations introduced by TALEN pair TaSBEIIa_T02

SEQ ID NO: 1264 - DNA, 468 bp, Artificial; identical to SEQ ID NO: 1027
  TaSBEIIa-A allele with mutations introduced by TALEN pair TaSBEIIa_T02

SEQ ID NO: 1265 - DNA, 461 bp, Artificial; identical to SEQ ID NO: 1096
  TaSBEIIa-A allele with mutations introduced by TALEN pair TaSBEIIa_T02

SEQ ID NO: 1266 - DNA, 456 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattcaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttcccctcatggtctgag

SEQ ID NO: 1267 - DNA, 464 bp, Artificial; identical to SEQ ID NO: 1054
  TaSBEIIa-A allele with mutations introduced by TALEN pair TaSBEIIa_T02

SEQ ID NO: 1268 - DNA, 465 bp, Artificial; identical to SEQ ID NO: 1019
  TaSBEIIa-A allele with mutations introduced by TALEN pair TaSBEIIa_T02

SEQ ID NO: 1269 - DNA, 464 bp, Artificial; identical to SEQ ID NO: 1054
  TaSBEIIa-A allele with mutations introduced by TALEN pair TaSBEIIa_T02

SEQ ID NO: 1270 - DNA, 466 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcattaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgct

SEQ ID NO: 1271 - DNA, 460 bp, Artificial; identical to SEQ ID NO: 1136
  TaSBEIIa-A allele with mutations introduced by TALEN pair TaSBEIIa_T02

SEQ ID NO: 1272 - DNA, 460 bp, Artificial; identical to SEQ ID NO: 969
  TaSBEIIa-A allele with mutations introduced by TALEN pair TaSBEIIa_T02

SEQ ID NO: 1273 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccccctcatggtctgagaatatgct

SEQ ID NO: 1274 - DNA, 385 bp, Artificial; identical to SEQ ID NO: 1033
  TaSBEIIa-A allele with mutations introduced by TALEN pair TaSBEIIa_T02

SEQ ID NO: 1275 - DNA, 461 bp, Artificial; identical to SEQ ID NO: 1096
  TaSBEIIa-A allele with mutations introduced by TALEN pair TaSBEIIa_T02

SEQ ID NO: 1276 - DNA, 466 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcatcatgcaaatttggggaacatcaaagagacaaagactagggaccaccatttcatacagatcccctcgtggtctgagaatatgctggga

SEQ ID NO: 1277 - DNA, 462 bp, Artificial; identical to SEQ ID NO: 1087
  TaSBEIIa-A allele with mutations introduced by TALEN pair TaSBEIIa_T02

SEQ ID NO: 1278 - DNA, 465 bp, Artificial
  TaSBEIIa-A allele with mutations introduced by TALEN pair TaSBEIIa_T02
  misc_feature (187): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcatgngaacaatcactgatggtgtaaccaaaggagttaaggaactagtcgtgggggagaaaccgcgagttgtcccaaaaccaggagatggggcgaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1279 - DNA, 463 bp, Artificial; identical to SEQ ID NO: 993
  TaSBEIIa-A allele with mutations introduced by TALEN pair TaSBEIIa_T02

SEQ ID NO: 1280 - DNA, 464 bp, Artificial; identical to SEQ ID NO: 1054
  TaSBEIIa-A allele with mutations introduced by TALEN pair TaSBEIIa_T02

SEQ ID NO: 1281 - DNA, 463 bp, Artificial; identical to SEQ ID NO: 993
  TaSBEIIa-A allele with mutations introduced by TALEN pair TaSBEIIa_T02

SEQ ID NO: 1282 - DNA, 717 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaagcatttttgacaagaaatatttgctagctgatagtgaccttaggcgacttttgaacgcggtccagcggctgttgccggtgctgtgccaggcccacggcttgaccccggagcaggtggtggccatcgccagcaatattggtggtatccggtaagcggcagggtcggaacaggagagcgcacgaggggagcttccaccttcatctccaggatacggtcctgggtgctgttccgggcgatctcgatcagctcgaacaatcactgatggtgtaaccaaaggagttaaggaactagtcgtgggggagaaaccgcgagttgtcccaaaaccaggagatgggcagaaaaatatacgagattgaccaacgctgaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggg

SEQ ID NO: 1283 - DNA, 464 bp, Artificial; identical to SEQ ID NO: 1054
  TaSBEIIa-A allele with mutations introduced by TALEN pair TaSBEIIa_T02

SEQ ID NO: 1284 - DNA, 460 bp, Artificial; identical to SEQ ID NO: 1170
  TaSBEIIa-A allele with mutations introduced by TALEN pair TaSBEIIa_T02

SEQ ID NO: 1285 - DNA, 465 bp, Artificial; identical to SEQ ID NO: 994
  TaSBEIIa-A allele with mutations introduced by TALEN pair TaSBEIIa_T02

SEQ ID NO: 1286 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaata

SEQ ID NO: 1287 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaacttgaatcttcagaaccgactcaaggcattgaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1288 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgct

SEQ ID NO: 1289 - DNA, 464 bp, Artificial; identical to SEQ ID NO: 1054
  TaSBEIIa-A allele with mutations introduced by TALEN pair TaSBEIIa_T02

SEQ ID NO: 1290 - DNA, 429 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagatggtgtaaccaaaggagttaaggaactatcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaagagacaaagactagggaccactatttcttacagttcccctcatggtctgagaatatgc

SEQ ID NO: 1291 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatcaatcactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1292 - DNA, 462 bp, Artificial; identical to SEQ ID NO: 1086
  TaSBEIIa-A allele with mutations introduced by TALEN pair TaSBEIIa_T02

SEQ ID NO: 1293 - DNA, 464 bp, Artificial; identical to SEQ ID NO: 1054
  TaSBEIIa-A allele with mutations introduced by TALEN pair TaSBEIIa_T02

SEQ ID NO: 1294 - DNA, 432 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagatggtgtaaccaaaggagttaaggaactagtcgtgggggagaaaccgcgagttgtccccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgc

SEQ ID NO: 1295 - DNA, 457 bp, Artificial; identical to SEQ ID NO: 1162
  TaSBEIIa-A allele with mutations introduced by TALEN pair TaSBEIIa_T02

SEQ ID NO: 1296 - DNA, 417 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcactgatggtgtaaccaaaggagttaaggaactagtcgtggggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaatgagacaaagactagggaccacta

SEQ ID NO: 1297 - DNA, 458 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctaatctgctcattttgaattaaggtcctttcatcatgcaaatttggggaacatcaaagaggcaaagactagggaccactatttcatacagttcccctcatggtctgagaatatgct

SEQ ID NO: 1298 - DNA, 461 bp, Artificial; identical to SEQ ID NO: 1096
  TaSBEIIa-A allele with mutations introduced by TALEN pair TaSBEIIa_T02

SEQ ID NO: 1299 - DNA, 456 bp, Artificial; identical to SEQ ID NO: 1050
  TaSBEIIa-A allele with mutations introduced by TALEN pair TaSBEIIa_T02

SEQ ID NO: 1300 - DNA, 465 bp, Artificial; identical to SEQ ID NO: 1005
  TaSBEIIa-A allele with mutations introduced by TALEN pair TaSBEIIa_T02
  misc_feature (186): n is a or c or t or g

SEQ ID NO: 1301 - DNA, 462 bp, Artificial; identical to SEQ ID NO: 1093
  TaSBEIIa-A allele with mutations introduced by TALEN pair TaSBEIIa_T02

SEQ ID NO: 1302 - DNA, 459 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1303 - DNA, 461 bp, Artificial; identical to SEQ ID NO: 1096
  TaSBEIIa-A allele with mutations introduced by TALEN pair TaSBEIIa_T02

SEQ ID NO: 1304 - DNA, 556 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattcttcaattcttcaacggtagcttcacggttcggttcactccccatcaaagaattcaccttgcaagccaatacacacaatagcccaaacggcgggggttatgtccatgaatatgcattttcatcttatgcttccaactagcaaaataacaatcactgatggtgtaaccaaaggagttaaggaactagtcgtgggggagaaaccgcgagttgtcccaaaaccaggagatgggcagaaaatatacgagattgacccaacgctgaaagatttttcggagccatcttgactaccggtaatgcctacccgctactttcgctcattttgaattaaggtcctttcgtcatgcaaatttggggaacatcaaagagacaaa

SEQ ID NO: 1305 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1306 - DNA, 717 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaagcattttttgacaagaaatatttgctagctgatagtgaccttaggcgacttttgaacgcggtccagcggctgttgccggtgctgtgccaggcccacggcttgaccccggagcaggtggtggccatcgccagcaatattggtggtatccggtaagcggcagggtcggaacaggagagcgcacgaggggagcttccaccttcatctccaggatacggtcctgggtgctgttccgggcgatctcgatcagctcgaacaatcactgatggtgtaaccaaaggagttaaggaactagtcgtgggggagaaaccgcgagttgtcccaaaaccaggagatgggcagaaaatatacgagattgacccaacgctgaagattttcggagccatcttgactaccggtaatgcctacccgctactttcgctcattttgaattaaggtcctttcgtcatgcaaattttgggaacatcaaaagagacaaagactagggaccactatttcttacagttccctcatggtctgagaatatgctggg

SEQ ID NO: 1307 - DNA, 462 bp, Artificial; identical to SEQ ID NO: 1087
  TaSBEIIa-A allele with mutations introduced by TALEN pair TaSBEIIa_T02

SEQ ID NO: 1308 - DNA, 459 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1309 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgaccaacgctgaaagattttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctggga

SEQ ID NO: 1310 - DNA, 462 bp, Artificial
  TaSBEIIa-A allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaaggcatatcactgatggtgtaaccaaaggagttaaggaactagtcgtgggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccccctcatggtctgagaatatgct

SEQ ID NO: 1311 - DNA, 460 bp, Artificial; identical to SEQ ID NO: 1114
  TaSBEIIa-A allele with mutations introduced by TALEN pair TaSBEIIa_T02

SEQ ID NO: 1312 - DNA, 466 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattaaacaatcactgatggtgtaaccaaaggagttaaggaactagtcgtgggggagaaaccgcgagttgtcccaaaaccaggagatggggcgaaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgct

SEQ ID NO: 1313 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcattcagaacctgactcaaggcatgatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1314 - DNA, 460 bp, Artificial; identical to SEQ ID NO: 1136
  TaSBEIIa-A allele with mutations introduced by TALEN pair TaSBEIIa_T02

SEQ ID NO: 1315 - DNA, 461 bp, Artificial; identical to SEQ ID NO: 1096
  TaSBEIIa-A allele with mutations introduced by TALEN pair TaSBEIIa_T02

SEQ ID NO: 1316 - DNA, 461 bp, Artificial; identical to SEQ ID NO: 1096
  TaSBEIIa-A allele with mutations introduced by TALEN pair TaSBEIIa_T02

SEQ ID NO: 1317 - DNA, 464 bp, Artificial; identical to SEQ ID NO: 1054
  TaSBEIIa-A allele with mutations introduced by TALEN pair TaSBEIIa_T02

SEQ ID NO: 1318 - DNA, 468 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgaaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1319 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgacaatcactgatggtgtaaccaaaggagttaaggaactagtcgtggggggagaaccgcgagttgatcccaaaaccaggagatggggcagaaaatatacgagattgcccaacgctgaaagattttcggagccatcttgactaccggtaatgcttacccgctactttcgctcattttgaattaaggtcctttcgtcatgcaaatttggggaacatcaaagagacaaagactagggaccactatttcttacagttcccctcatggtctgagaatatgct

SEQ ID NO: 1320 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaagacatacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1321 - DNA, 466 bp, Artificial; identical to SEQ ID NO: 1017
  TaSBEIIa-A allele with mutations introduced by TALEN pair TaSBEIIa_T02

SEQ ID NO: 1322 - DNA, 463 bp, Artificial
  TaSBEIIa-A allele with mutations introduced by TALEN pair TaSBEIIa_T02
agatggatgtgcattctagcaagaacttcacaacataatgcaccgtttgggggtttcgtcagtctgctctacaattgctattttcgtgctgtagatacctgaagacatcgaggagcaaacggctgaagtaaacatgacagggggactgcagaaaaacttgaatcttcagaaccgactcaaggcattacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1323 - DNA, 454 bp, Artificial; identical to SEQ ID NO: 1034
  TaSBEIIa-A allele with mutations introduced by TALEN pair TaSBEIIa_T02

SEQ ID NO: 1324 - DNA, 461 bp, Artificial; identical to SEQ ID NO: 1096
  TaSBEIIa-A allele with mutations introduced by TALEN pair TaSBEIIa_T02

SEQ ID NO: 1325 - DNA, 525 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgttctccgctcatgatcattggatctagatgcattcgcgaggtaccgagctcgaattcactggccgtcaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgc

SEQ ID NO: 1326 - DNA, 464 bp, Artificial; identical to SEQ ID NO: 1054
  TaSBEIIa-A allele with mutations introduced by TALEN pair TaSBEIIa_T02

SEQ ID NO: 1327 - DNA, 462 bp, Artificial; identical to SEQ ID NO: 1086
  TaSBEIIa-A allele with mutations introduced by TALEN pair TaSBEIIa_T02

SEQ ID NO: 1328 - DNA, 637 bp, Artificial
  TaSBEIIa-A allele with mutations introduced by TALEN pair TaSBEIIa_T02
  misc_feature (595): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaagcatttttgacaagaaatatttgctagctgatagtgaccttaggcgacttttgaacgcggtccagcggctgttgccggtgctgtgccaggcccacggcttgaccccggagcaggtggtggccatcgccagcaatattggtggtatccggtaagcggcagggtcggaacaggagagcgcacgaggggagcttccaccttcatctccaggatacggtcctgggtgctgttccgggcgatctcgatcagctcgaacaatcactgatggtgtaaccaaaggagttaaggaactagtcgtgggggagaaaccgcgagttgtcccaaaaccaggagatgggcagaaaatatacgagattgaccaacgctgaagattttcggagccacttgacctaccggtaatgcctacccgntactttcgctcattttgaattaaggtcctttcgtcatgcaaa

SEQ ID NO: 1329 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgct

SEQ ID NO: 1330 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattcaatcactgatggtgtaaccaaaggagttaaggaactagtcgtgggggagaaaccgcgagttgtcccaaaaccaggagatggggcagaaaaatatacgagattgaccccaacgctgaaagatttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1331 - DNA, 385 bp, Artificial; identical to SEQ ID NO: 1033
  TaSBEIIa-A allele with mutations introduced by TALEN pair TaSBEIIa_T02

SEQ ID NO: 1332 - DNA, 465 bp, Artificial
  TaSBEIIa-A allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggctgaagtaaacatgacagggggactgcagaaaaacttgaatcttcagaaccgactcaaggcattaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1333 - DNA, 467 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaaaacaatcactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccaccattttcatacagatccccctcgtggtctgagaatatgct

SEQ ID NO: 1334 - DNA, 463 bp, Artificial; identical to SEQ ID NO: 993
  TaSBEIIa-A allele with mutations introduced by TALEN pair TaSBEIIa_T02

SEQ ID NO: 1335 - DNA, 458 bp, Artificial; identical to SEQ ID NO: 1176
  TaSBEIIa-A allele with mutations introduced by TALEN pair TaSBEIIa_T02

SEQ ID NO: 1336 - DNA, 467 bp, Artificial
  TaSBEIIa-A allele with mutations introduced by TALEN pair TaSBEIIa_T02
  misc_feature (196): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaaatgcatgacacngatggtgtaaccaaaggagttaaggaactagtcgtggggggagaaaccgcgagttgtcccaaaaccaggagatggggcagaaaaatatacgagattgacccaacgctgaaagatttttcggagccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgct

SEQ ID NO: 1337 - DNA, 461 bp, Artificial; identical to SEQ ID NO: 1096
  TaSBEIIa-A allele with mutations introduced by TALEN pair TaSBEIIa_T02

SEQ ID NO: 1338 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaaaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1339 - DNA, 468 bp, Artificial; identical to SEQ ID NO: 1027
  TaSBEIIa-A allele with mutations introduced by TALEN pair TaSBEIIa_T02

SEQ ID NO: 1340 - DNA, 461 bp, Artificial; identical to SEQ ID NO: 1132
  TaSBEIIa-A allele with mutations introduced by TALEN pair TaSBEIIa_T02

SEQ ID NO: 1341 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaaagactagggaccactatttcttacagttcccctcatggtctgagaatatgct

SEQ ID NO: 1342 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1343 - DNA, 465 bp, Artificial; identical to SEQ ID NO: 1019
  TaSBEIIa-A allele with mutations introduced by TALEN pair TaSBEIIa_T02

SEQ ID NO: 1344 - DNA, 454 bp, Artificial; identical to SEQ ID NO: 1034
  TaSBEIIa-A allele with mutations introduced by TALEN pair TaSBEIIa_T02

SEQ ID NO: 1345 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttccccctcatggtctgagaatatgctggga

SEQ ID NO: 1346 - DNA, 457 bp, Artificial; identical to SEQ ID NO: 1162
  TaSBEIIa-A allele with mutations introduced by TALEN pair TaSBEIIa_T02

SEQ ID NO: 1347 - DNA, 462 bp, Artificial; identical to SEQ ID NO: 1086
  TaSBEIIa-A allele with mutations introduced by TALEN pair TaSBEIIa_T02

SEQ ID NO: 1348 - DNA, 461 bp, Artificial; identical to SEQ ID NO: 1096
  TaSBEIIa-A allele with mutations introduced by TALEN pair TaSBEIIa_T02

SEQ ID NO: 1349 - DNA, 465 bp, Artificial; identical to SEQ ID NO: 994
  TaSBEIIa-A allele with mutations introduced by TALEN pair TaSBEIIa_T02

SEQ ID NO: 1350 - DNA, 480 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaaggatcttcacctagatccttttaaattaaaaatgcaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatgg

SEQ ID NO: 1351 - DNA, 498 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattaaggaatctttcacctagatccttttaaattaaaaatgcaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1352 - DNA, 467 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaacctgactcaaggcattgatcactgatggtgtaaccaaaggagttaaggaactagtcgtggggggagaaaccgcgagttggtcccaaaaccaggagatggggcagaaaaatatacgagattgacccaacgctgaaagaattttcggagccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgct

SEQ ID NO: 1353 - DNA, 432 bp, Artificial; identical to SEQ ID NO: 1049
  TaSBEIIa-A allele with mutations introduced by TALEN pair TaSBEIIa_T02

SEQ ID NO: 1354 - DNA, 653 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaggtggcacttttcggggaaatgtgcgcggaacccctatttgtttattttttctaaatacaaacccaacagacactttcggagatacccatagtttcaacacactcatacgaaagttttattatttaggccaccacttcaagaactctgtagcaccttcggtcctccgatcgttgtcagaagtaagttacaatcactgatggtgtaaccaaaggagttaaggaactagtcgtgggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 1355 - DNA, 455 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 1356 - DNA, 466 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattgaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1357 - DNA, 459 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgagggagcaaacggctgaagtaacatgacagggggactgcagaaaaacttgaatcttcagaaccgactcaaggcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggacccactattttcttacagttccccctcatggtctgagaatatgct

SEQ ID NO: 1358 - DNA, 460 bp, Artificial; identical to SEQ ID NO: 977
  TaSBEIIa-A allele with mutations introduced by TALEN pair TaSBEIIa_T02

SEQ ID NO: 1359 - DNA, 459 bp, Artificial; identical to SEQ ID NO: 990
  TaSBEIIa-A allele with mutations introduced by TALEN pair TaSBEIIa_T02

SEQ ID NO: 1360 - DNA, 462 bp, Artificial; identical to SEQ ID NO: 1087
  TaSBEIIa-A allele with mutations introduced by TALEN pair TaSBEIIa_T02

SEQ ID NO: 1361 - DNA, 463 bp, Artificial; identical to SEQ ID NO: 993
  TaSBEIIa-A allele with mutations introduced by TALEN pair TaSBEIIa_T02

SEQ ID NO: 1362 - DNA, 456 bp, Artificial; identical to SEQ ID NO: 1050
  TaSBEIIa-A allele with mutations introduced by TALEN pair TaSBEIIa_T02

SEQ ID NO: 1363 - DNA, 465 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcaaaacaatcactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1364 - DNA, 495 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcattaaggaatcttcacctagatccttttaaattaaaaatgcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatg

SEQ ID NO: 1365 - DNA, 460 bp, Artificial; identical to SEQ ID NO: 1136
  TaSBEIIa-A allele with mutations introduced by TALEN pair TaSBEIIa_T02

SEQ ID NO: 1366 - DNA, 437 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagatggtgtaaccaaaggagttaaggaactagtcgtgggggagaaaccgcgagttgtcccaaaaccaggagatggggcagaaaatatacgagattgacccaacactgaaagatttttcggagccatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctggg

SEQ ID NO: 1367 - DNA, 384 bp, Artificial; identical to SEQ ID NO: 968
  TaSBEIIa-A allele with mutations introduced by TALEN pair TaSBEIIa_T02

SEQ ID NO: 1368 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactattttcttacagttcccctcatggtctgagaatatgctggga

SEQ ID NO: 1369 - DNA, 465 bp, Artificial; identical to SEQ ID NO: 1019
  TaSBEIIa-A allele with mutations introduced by TALEN pair TaSBEIIa_T02

SEQ ID NO: 1370 - DNA, 461 bp, Artificial; identical to SEQ ID NO: 1096
  TaSBEIIa-A allele with mutations introduced by TALEN pair TaSBEIIa_T02

SEQ ID NO: 1371 - DNA, 466 bp, Artificial; identical to SEQ ID NO: 1017
  TaSBEIIa-A allele with mutations introduced by TALEN pair TaSBEIIa_T02

SEQ ID NO: 1372 - DNA, 464 bp, Artificial; identical to SEQ ID NO: 1054
  TaSBEIIa-A allele with mutations introduced by TALEN pair TaSBEIIa_T02

SEQ ID NO: 1373 - DNA, 464 bp, Artificial
  TaSBEIIa-A allele with mutations introduced by TALEN pair TaSBEIIa_T02
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagaaaacatgatcattctagaaccgactcaaggcatagacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1374 - DNA, 463 bp, Artificial; identical to SEQ ID NO: 993
  TaSBEIIa-A allele with mutations introduced by TALEN pair TaSBEIIa_T02

SEQ ID NO: 1375 - DNA, 465 bp, Artificial; identical to SEQ ID NO: 1019
  TaSBEIIa-A allele with mutations introduced by TALEN pair TaSBEIIa_T02

SEQ ID NO: 1376 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgct

SEQ ID NO: 1377 - DNA, 455 bp, Artificial
  TaSBEIIa-A allele with mutations introduced by TALEN pair TaSBEIIa_T02
agatggatgtgcattctagcaagaacttcgacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaacaatcactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctg

SEQ ID NO: 1378 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1379 - DNA, 530 bp, Artificial; identical to SEQ ID NO: 1091
  TaSBEIIa-A allele with mutations introduced by TALEN pair TaSBEIIa_T02

SEQ ID NO: 1380 - DNA, 467 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaacctgactcaaggcaacaatcactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcatcatgcaaatttggggaacatcaaagagacaaagactagggaccaccatttcatacagatcccctcgtggtctgagaatatgctggga

SEQ ID NO: 1381 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1382 - DNA, 454 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcataacaatcactgatggtgtaaccaaaggagttaaggaactagtcgtgggggagaaaccgcgagttgtcccaaaaccaggagatggggcagaaaaatatacgagattgacccaacgctgaaaagattttcggagccatcttgactaccggtaatgcctacccgctactttcgctcattttgaattaaggtcctttcgtcatgcaaatttggggaacatcaaagagacaaaagactagggaccactatttcttacagttcccctcatggtctg

SEQ ID NO: 1383 - DNA, 516 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattggactccccgtcgtgtagataactacgatacgggagggcttaccatctggcctaaacaatcactgatggtgtaaccaaaaggagttaaggaactagtcgtggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1384 - DNA, 457 bp, Artificial
  TaSBEIIa-A allele with mutations introduced by TALEN pair TaSBEIIa_T02
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagaaaaacttgaatcttcagaaccgactcaaggcaatcactgatggtgtaaccaaaggagttaaggaaactagtcgtgggggagaaaccgcgagttgtcccaaaaccaggagatgggcagaaaatatacgagattgacccaacgcctgaaagattttcggaagtccatcttgactaccggtaatgcctacccgctactttcgctcattttgaattaaggtcctttcgtcatgcaaatttggggaacatcaaagagacaaagactagggaccactatttcttacagttcccctcatggtctgagaatat

SEQ ID NO: 1385 - DNA, 424 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggacc

SEQ ID NO: 1386 - DNA, 472 bp, Artificial
  TaSBEIIa-A allele with mutations introduced by TALEN pair TaSBEIIa_T02
  misc_feature (302); (330): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcaggaaccgactcaaggcattaacaatcactgatggtgtaaccaaaggagttaaggaactagtcgtgggggagaaaccgcgagttgtcccaaaaccaggagatggggcagaaaaatatacgagattgacccaacgcngaaagaattttcggatgccatcttgacnaccggtaatgcctaccccgctactttcgctcattttgaattaaggtcctttcgtcatgcaaatttgggggaacatcaaagagacaaagactaggggaccactatttcttacagtttccccctcatggtctgagaaatatgct

SEQ ID NO: 1387 - DNA, 719 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaagcatttttgacaagaaatatttgctagctgatagtgaccttaggcgacttttgaacgcggtccagcggctgttgccggtgctgtgccaggcccacggcttgaccccggagcaggtggtggccatcgccagcaatattggtggtatccggtaagcggcagggtcggaacaggagagcgcacgaggggagcttccaccttcatctccaggatacggtcctgggtgctgttccgggcgatctcgatcagctcgaacaatcactgatggtgtaaccaaaggagttaaggaactagtcgtgggggagaaaccgcgagttgtcccaaaaccaggagatgggcagaaaaatatacgagattgacccaacgctgaagattttcggagccaatcttgactaccggtaatgcctacccgctactttcgctcattttgaattaaggtcctttcgtcatgcaaattttggggaacatcaaaagagacaaagactagggaccactatttcttacagttccctcatggtctgagaatatgctggg

SEQ ID NO: 1388 - DNA, 463 bp, Artificial; identical to SEQ ID NO: 1055
  TaSBEIIa-A allele with mutations introduced by TALEN pair TaSBEIIa_T02

SEQ ID NO: 1389 - DNA, 514 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattggactccccgtcgtgtagataactacgatacgggagggcttaccatctggcctaaacaatcactgatggtgtaaccaaaggagttaaggaactagtcgtggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgaaatatgct

SEQ ID NO: 1390 - DNA, 463 bp, Artificial; identical to SEQ ID NO: 993
  TaSBEIIa-A allele with mutations introduced by TALEN pair TaSBEIIa_T02

SEQ ID NO: 1391 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctaattctgctcattttgaattaaggtcctttcatcatagcaatttggggaacatcaaagaggcaaagactaggggaccactatttcttacagttcccctcatggtctgagaatatgct

SEQ ID NO: 1392 - DNA, 456 bp, Artificial; identical to SEQ ID NO: 1050
  TaSBEIIa-A allele with mutations introduced by TALEN pair TaSBEIIa_T02

SEQ ID NO: 1393 - DNA, 514 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcattgtggtagcttccgccgcctgcgcttccagcaattccgactcttcaataacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaaagactagggaaccactatttcttacagtttcccctcatggtctgagaatatgct

SEQ ID NO: 1394 - DNA, 457 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1395 - DNA, 457 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattatggtgtaaccaaaggagttaaggaactagtcgtgggggagaaaccgcgagttgtcccaaaaccaggagatgggcagaaaatatacgagattgacccaacactgaaaagattttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 1396 - DNA, 457 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaacaatcactgatggtgtaaccaaaggagttaaggaactagtcgtgggggagaaaccgcgagttgtcccaaaaccaggagatgggcagaaaatatacgagattgaccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1397 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcataacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1398 - DNA, 460 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcactgatggtgtaaccaaaggagttaaggaactagtcgtggggggagaaaccgcgagttgtcccaaaaaccaggagatgggcagaaaatatacgagattgacccaacgctgaaaagattttcggagccatcttgactaccggtaatgcctacccgctactttcgctcattttgaattaaggtcctttcgtcatgcaaatttggggaacatcaaaagagacaaagactagggaccactattttcttacagttcccctcatggtctgagaatatgctggga

SEQ ID NO: 1399 - DNA, 468 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaaccgactcaaggcaacaatcactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcatcatgcaaatttggggaacatcaaagagacaaagactagggaccaccattttcatacagatcccctcgtggtctgagaatatgctggga

SEQ ID NO: 1400 - DNA, 462 bp, Artificial; identical to SEQ ID NO: 965
  TaSBEIIa-A allele with mutations introduced by TALEN pair TaSBEIIa_T02

SEQ ID NO: 1401 - DNA, 458 bp, Artificial; identical to SEQ ID NO: 1048
  TaSBEIIa-A allele with mutations introduced by TALEN pair TaSBEIIa_T02

SEQ ID NO: 1402 - DNA, 459 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctaacaattgctattttcgtgctgtagatacctgaagacatcgaggagcaaacggctgaagtaaacatgacagggggactgcagaaaaacttgaatcttcagaaccgactcaaggcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaaattaaggtcctttcgtcatgcaaatttggggaacatcaaagagacaaagactagggaccactattttcttacagttcccctcatggtctgagaatatgctggga

SEQ ID NO: 1403 - DNA, 508 bp, Artificial; identical to SEQ ID NO: 1051
  TaSBEIIa-A allele with mutations introduced by TALEN pair TaSBEIIa_T02

SEQ ID NO: 1404 - DNA, 463 bp, Artificial; identical to SEQ ID NO: 993
  TaSBEIIa-A allele with mutations introduced by TALEN pair TaSBEIIa_T02

SEQ ID NO: 1405 - DNA, 464 bp, Artificial; identical to SEQ ID NO: 1054
  TaSBEIIa-A allele with mutations introduced by TALEN pair TaSBEIIa_T02

SEQ ID NO: 1406 - DNA, 432 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgc

SEQ ID NO: 1407 - DNA, 459 bp, Artificial; identical to SEQ ID NO: 990
  TaSBEIIa-A allele with mutations introduced by TALEN pair TaSBEIIa_T02

SEQ ID NO: 1408 - DNA, 462 bp, Artificial; identical to SEQ ID NO: 1086
  TaSBEIIa-A allele with mutations introduced by TALEN pair TaSBEIIa_T02

SEQ ID NO: 1409 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatataatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1410 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaacttgaatcattcagaaccgactcaaggcaacaatcactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgct

SEQ ID NO: 1411 - DNA, 467 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaacatgacaggggggacctgcagaaaacatatcattctagaaccgactcaagggcattgagacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgct

SEQ ID NO: 1412 - DNA, 459 bp, Artificial
  TaSBEIIa-A allele with mutations introduced by TALEN pair TaSBEIIa_T02
  misc_feature (45): n is a or c or t or g
agatggatgtgcattctagcaagaacttcacgaaataatgcactntttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1413 - DNA, 461 bp, Artificial; identical to SEQ ID NO: 1288
  TaSBEIIa-A allele with mutations introduced by TALEN pair TaSBEIIa_T02

SEQ ID NO: 1414 - DNA, 459 bp, Artificial; identical to SEQ ID NO: 1059
  TaSBEIIa-A allele with mutations introduced by TALEN pair TaSBEIIa_T02

SEQ ID NO: 1415 - DNA, 455 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattatggtgtaaccaaaggagttaaggaactagtcgtggggggagaaaccgcgagttgtcccaaaaccaggagatgggcagaaaatatacgagattgacccaacgctgaaaagattttcggagccatcttgactaccggtaatgcctacccgctgctttcgctcattttgaattaaggtcctttctcatgcaaatttggggaacatcaaagagacaaagactagggaccacattttcatacagatcccctcgtggtctgagaatatgctggga

SEQ ID NO: 1416 - DNA, 402 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctatttcgtgctgtagatacctgaagacatcgaggagcaaacggctgaagtaaacatgacagggggactgcagaaaaacttgaatcttcagaaccgactcaaggcaccgcgagttgtcccaaaaccaggagatgggcagaaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactatttcttacagttcccctcatggtctgagaatatgc

SEQ ID NO: 1417 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattcatgacactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtccttttcatcatagcaattttggggaacatcaaagaggcaaagactagggaccactatttcatacagttcccctcatggtctgagaatatgct

SEQ ID NO: 1418 - DNA, 454 bp, Artificial; identical to SEQ ID NO: 1098
  TaSBEIIa-A allele with mutations introduced by TALEN pair TaSBEIIa_T02

SEQ ID NO: 1419 - DNA, 468 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccaccatttcatacagatcccctcgtggtctgagaatatgctggga

SEQ ID NO: 1420 - DNA, 460 bp, Artificial; identical to SEQ ID NO: 977
  TaSBEIIa-A allele with mutations introduced by TALEN pair TaSBEIIa_T02

SEQ ID NO: 1421 - DNA, 522 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtgcacatcgttgcgttaagccaacacccggcagcgttagggaccgtcgctgtcaagtatcaacaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctaatttcgctcatttttgaattaaggtcctttcatcatgcaaatttggggaacatcaaagaggcaaagactagggaccactatttcatacagttcccctcatggtctgagaatatgct

SEQ ID NO: 1422 - DNA, 431 bp, Artificial; identical to SEQ ID NO: 1113
  TaSBEIIa-A allele with mutations introduced by TALEN pair TaSBEIIa_T02

SEQ ID NO: 1423 - DNA, 460 bp, Artificial; identical to SEQ ID NO: 1170
  TaSBEIIa-A allele with mutations introduced by TALEN pair TaSBEIIa_T02

SEQ ID NO: 1424 - DNA, 463 bp, Artificial; identical to SEQ ID NO: 993
  TaSBEIIa-A allele with mutations introduced by TALEN pair TaSBEIIa_T02

SEQ ID NO: 1425 - DNA, 465 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgagacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1426 - DNA, 458 bp, Artificial; identical to SEQ ID NO: 1176
  TaSBEIIa-A allele with mutations introduced by TALEN pair TaSBEIIa_T02

SEQ ID NO: 1427 - DNA, 457 bp, Artificial; identical to SEQ ID NO: 1394
  TaSBEIIa-A allele with mutations introduced by TALEN pair TaSBEIIa_T02

SEQ ID NO: 1428 - DNA, 544 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgcgaggtggtcgttggtcaacgcggccaacgccggatcaggcgcgtcagcgggtgttggcgggtgtcggggctggctaaacaatcactgatggtgtaaccaaaggagttaaggaactagtcgtgggggagaaaccgcgagttgtcccaaaaccaggagatggggcagaaaatatacgagattgacccaacgctgaaagattttcggagccatcttgactaccggtaatgcctacccgctactttcgctcattttgaattaaggtcctttcgtcatgcaatttggggaacatcaagagacaaagactagggacccactatttcttacagttcccctcatggtctgagaagtatgctggga

SEQ ID NO: 1429 - DNA, 433 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagatggtgtaaccaaaggagttaaggaactagtcgtggggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgc

SEQ ID NO: 1430 - DNA, 460 bp, Artificial; identical to SEQ ID NO: 1345
  TaSBEIIa-A allele with mutations introduced by TALEN pair TaSBEIIa_T02

SEQ ID NO: 1431 - DNA, 522 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgcccagctggtgaagtccgagctggaggagaagaaatccgagttgaggcacaagctgaagtacgtgccccacgagttggtgtaaccaaaggagttaaggaactagtcgtggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttgggaacatcaaagaagacaaagactagggaccgactattttcttacagttcccctcatggtctgagaat

SEQ ID NO: 1432 - DNA, 463 bp, Artificial; identical to SEQ ID NO: 1031
  TaSBEIIa-A allele with mutations introduced by TALEN pair TaSBEIIa_T02

SEQ ID NO: 1433 - DNA, 455 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattggtgtaaccaaaggagttaaggaactagtcgtggggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1434 - DNA, 461 bp, Artificial; identical to SEQ ID NO: 1096
  TaSBEIIa-A allele with mutations introduced by TALEN pair TaSBEIIa_T02

SEQ ID NO: 1435 - DNA, 457 bp, Artificial; identical to SEQ ID NO: 1162
  TaSBEIIa-A allele with mutations introduced by TALEN pair TaSBEIIa_T02

SEQ ID NO: 1436 - DNA, 463 bp, Artificial; identical to SEQ ID NO: 993
  TaSBEIIa-A allele with mutations introduced by TALEN pair TaSBEIIa_T02

SEQ ID NO: 1437 - DNA, 642 bp, Artificial
  TaSBEIIa-A allele with mutations introduced by TALEN pair TaSBEIIa_T02
  misc_feature (597): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaagcatttttgacaagaaatatttgctagctgatagtgaccttaggcgacttttgaacgcggtccagcggctgttgccggtgctgtgccaggcccacggcttgaccccggagcaggtggtggccatcgccagcaatattggtggtatccggtaagcggcagggtcggaacaggagagcgcacgaggggagcttccaccttcatctccaggatacggtcctgggtgctgttccgggcgatctcgatcagctcgaacaatcactgatggtgtaaccaaggagttaaggaactagtcgtgggggagaaaccgcgagttgtcccaaaaccaggagatgggcagaaaaatatacgagattgacccaacgctgaagattttcggagccatcttgactaccggtaatgcctacccgntactttcgctcattttgaattaaggtcctttcgtcatgcaaattt

SEQ ID NO: 1438 - DNA, 466 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1439 - DNA, 463 bp, Artificial; identical to SEQ ID NO: 993
  TaSBEIIa-A allele with mutations introduced by TALEN pair TaSBEIIa_T02

SEQ ID NO: 1440 - DNA, 405 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgc

SEQ ID NO: 1441 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaaacaatcactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1442 - DNA, 466 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaacatgacagggggactgcagaaaaacttgaatcttcagaaccgactcaaggcaaacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcacatgcaaatttggggaacatcaaagagacaaagactagggaccacccattttcatacagatccccctcgtggtctgagaatatgctggga

SEQ ID NO: 1443 - DNA, 465 bp, Artificial; identical to SEQ ID NO: 994
  TaSBEIIa-A allele with mutations introduced by TALEN pair TaSBEIIa_T02

SEQ ID NO: 1444 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaacaatcactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1445 - DNA, 459 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaatcatgacaactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctacttttcgctcattttgaattaaggtcctttcgtcatgcaaaatttggggaacatcaaagagacaaaagactagggaccactatttcttacagttcccctcatggtctgag

SEQ ID NO: 1446 - DNA, 463 bp, Artificial; identical to SEQ ID NO: 1378
  TaSBEIIa-A allele with mutations introduced by TALEN pair TaSBEIIa_T02

SEQ ID NO: 1447 - DNA, 466 bp, Artificial; identical to SEQ ID NO: 1017
  TaSBEIIa-A allele with mutations introduced by TALEN pair TaSBEIIa_T02

SEQ ID NO: 1448 - DNA, 720 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaagcattttttgacaagaaatatttgctagctgatagtgaccttaggcgacttttgaacgcggtccagcggctgttgccggtgctgtgccaggcccacggcttgaccccggagcaggtggtggccatcgccagcaatattggtggtatccggtaagcggcagggtcggaacaggagagcgcacgaggggagcttccaccttcatctccaggatacggtcctgggtgctgttccgggcgatctcgatcagctcgaacaatcactgatggtgtaaccaaaggagttaaggaactagtcgtgggggagaaaccgcgagttgtcccaaaaccaggagatgggcagaaaaatatacgagattgacccaacgctgaagattttcggagccatcttgactaccggtaatgcctacccgctactttcgctcattttgaattaaggtcctttcgtcatgcaaattttggggaacatcaaaagagacaaagactagggaccactatttcttacagttcccctcatggtctgagaatatgctggg

SEQ ID NO: 1449 - DNA, 694 bp, Artificial
  TaSBEIIa-A allele with mutations introduced by TALEN pair TaSBEIIa_T02
  misc_feature (590): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaagcatttttgacaagaaatatttgctagctgatagtgaccttaggcgacttttgaacgcggtccagcggctgttgccggtgctgtgccaggcccacggcttgaccccggagcaggtggtggccatcgccagcaatattggtggtatccggtaagcggcagggtcggaacaggagagcgcacgaggggagcttccaccttcatctccagggatacggtcctgggtgctgttccgggcgatctcgatcagctcgaacaatcactgatggtgtaaccaaaggagttaaggaactagtcgtgggggagaaaccgcgagttgtcccaaaaccaggagatgggcagaaaaatatacgagattgaccaacgctgaagattttcggagccacttgactaccggtaatgccnaccctgctacttcgctcattttgaattaaggtcctttgtcatgcaaaatttggggaaccatcaaaagagacaaagactagggaccactatttcttacagttccc

SEQ ID NO: 1450 - DNA, 530 bp, Artificial; identical to SEQ ID NO: 1091
  TaSBEIIa-A allele with mutations introduced by TALEN pair TaSBEIIa_T02

SEQ ID NO: 1451 - DNA, 463 bp, Artificial
  TaSBEIIa-A allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagaaaaacttgaatcttcagaaccgactcaaggcatcaatcactgatggtgtaaccaaaggagttaaggaactagtcgtgggggagaaaccgcgagttgttccaaaaccaggaagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1452 - DNA, 463 bp, Artificial
  TaSBEIIa-A allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttgaatcttcagaaccgactcaaggcatacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1453 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctacttttcgctcattttgaattaaggtcctttcgtcatgcaaatttggggaacatcaaagagacaaagactagggaccactatttcttacagttccccctcatggtctgagaatatgct

SEQ ID NO: 1454 - DNA, 651 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattaggtggcacttttcggggaaatgtgcgcggaacccctatttgtttattttttctaaatacaaacccaacagacactttcggagatacccatagtttcaacacactcatacgaaagtttttattatttaggccaccacttcaagaactctgtagcaccttcggtcctccgatcgttgtcagaagtaagttacaatcactgatggtgtaaccaaaggagttaaggaactagtcgtgggggagaaaccgcgagttgtcccaaaaccaggagatgggcagaaaatatacgagattgacccaacgctgaaagattttcggagcccatcttgactaccggtaatgcctacccgctactttcgctcattttgaattaaggtcctttcgtcatgcaaattttggggaacatcaaagagacaaagactagggaccactatttcttacagttcccctcatggtctgagaatatgct

SEQ ID NO: 1455 - DNA, 463 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttccccctcatggtctgagaatatgct

SEQ ID NO: 1456 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1457 - DNA, 523 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtgcacatcgttgcgttaagccaacacccggcagcgttagggaccgtcgctgtcaagtatcaacaatcactgatggtgtaaccaaaggagttaaggaactagtcgtggggagaaaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1458 - DNA, 460 bp, Artificial; identical to SEQ ID NO: 1044
  TaSBEIIa-A allele with mutations introduced by TALEN pair TaSBEIIa_T02

SEQ ID NO: 1459 - DNA, 466 bp, Artificial; identical to SEQ ID NO: 1105
  TaSBEIIa-A allele with mutations introduced by TALEN pair TaSBEIIa_T02

SEQ ID NO: 1460 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatcaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccccctcatggtctgagaatatgct

SEQ ID NO: 1461 - DNA, 464 bp, Artificial; identical to SEQ ID NO: 1001
  TaSBEIIa-A allele with mutations introduced by TALEN pair TaSBEIIa_T02

SEQ ID NO: 1462 - DNA, 463 bp, Artificial
  TaSBEIIa-A allele with mutations introduced by TALEN pair TaSBEIIa_T02
  misc_feature (194); (195): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattatgacaacnnatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1463 - DNA, 466 bp, Artificial; identical to SEQ ID NO: 1143
  TaSBEIIa-A allele with mutations introduced by TALEN pair TaSBEIIa_T02

SEQ ID NO: 1464 - DNA, 462 bp, Artificial; identical to SEQ ID NO: 1087
  TaSBEIIa-A allele with mutations introduced by TALEN pair TaSBEIIa_T02

SEQ ID NO: 1465 - DNA, 454 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatacaatcactgatggtgtaaccaaaggagttaaggaactagtcgtgggggagaaaccgcgagttgtcccaaaaccaggagatggggcagaaaaatatacgagattgacccaacggctgaaagattttcggagccatcttgagctacggtaatgcctacccgctactttcgctcattttgaattaaggtcctttcgtcatgcaaatttggggaacatcaaagagacaaagactagggaccactatttcttacagttcccctcatggtctgag

SEQ ID NO: 1466 - DNA, 466 bp, Artificial; identical to SEQ ID NO: 1017
  TaSBEIIa-A allele with mutations introduced by TALEN pair TaSBEIIa_T02

SEQ ID NO: 1467 - DNA, 816 bp, Artificial
  TaSBEIIa-A allele with mutations introduced by TALEN pair TaSBEIIa_T02
  misc_feature (466): n is a or c or t or g
agatggatgtgcattctagcaagaacttcacgaaataatgcactgttttgtggtttcgttagtctgctctacaatttgctattttcgtgctgtagatacctgaagacatcgaggagcaaacggctgaagtaaacattgacagggggactgcagaaaaacttgaatcttcagaaccgactcaaggcattgccaggatacggtcctgggtgctgttccgggcgatctcgatcagctcgagctcacgctgtaggtatctcagttcggtgtaggtcgttcgctccaagctgggctgtaataaaccagccagccggaagggccgagcgcagaagtggtcctgcaactttatccgcctcccaccagtctattaatttggttgcccggggaagctagagttcttgaagtgggtggcctaactacggctacactagaagaacagtatttggtatctgcgctctgctgaagccanttccttcggaaaagagttggtagctcttgatccaactgtaacggtggacctctcaactctcccgccaccgtgagcaaggccaacagttgcgcagcctgaatggcgaatggcgcctgatgcggtattttctccttacgcatctgtgcgcggtggtttgttgccggatcaagagctaccaatcactgatggtgtaaccaaaggagttaaggaactagtcgtgggggagaaaccgcgagttgtcccaaaaccaggagatgggcagaaaatatacgagattgacccaagcgctgaaagattttcggagccatcttgactaccggtaatgcctacccgctactttcgctcatttg

SEQ ID NO: 1468 - DNA, 543 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgcgaggtggtcgttggtcaacgcggccaacgccggatcaggcgcgtcagcgggtgttggcgggtgtcggggctggctaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 1469 - DNA, 525 bp, Artificial; identical to SEQ ID NO: 1325
  TaSBEIIa-A allele with mutations introduced by TALEN pair TaSBEIIa_T02

SEQ ID NO: 1470 - DNA, 461 bp, Artificial; identical to SEQ ID NO: 1011
  TaSBEIIa-A allele with mutations introduced by TALEN pair TaSBEIIa_T02

SEQ ID NO: 1471 - DNA, 462 bp, Artificial; identical to SEQ ID NO: 1087
  TaSBEIIa-A allele with mutations introduced by TALEN pair TaSBEIIa_T02

SEQ ID NO: 1472 - DNA, 465 bp, Artificial; identical to SEQ ID NO: 994
  TaSBEIIa-A allele with mutations introduced by TALEN pair TaSBEIIa_T02

SEQ ID NO: 1473 - DNA, 463 bp, Artificial; identical to SEQ ID NO: 993
  TaSBEIIa-A allele with mutations introduced by TALEN pair TaSBEIIa_T02

SEQ ID NO: 1474 - DNA, 463 bp, Artificial
  TaSBEIIa-A allele with mutations introduced by TALEN pair TaSBEIIa_T02
  misc_feature (196): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaacaacacgngtggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1475 - DNA, 468 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttccccctcatggtctgagaatatgct

SEQ ID NO: 1476 - DNA, 470 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggacgtgcagaaaaacttgaatcattcagaacctgactcaaggcattgacaatcactgatggtgtaaccaaaggagttaaggaactagtcgtggggggagaaaccgcgagttggtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactattttcttacagttcccctcatggtctgagaatatgct

SEQ ID NO: 1477 - DNA, 459 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagaacaaagactagggaccactattttcatacagttccccctcatggtctgagaatatgctggga

SEQ ID NO: 1478 - DNA, 464 bp, Artificial; identical to SEQ ID NO: 1376
  TaSBEIIa-A allele with mutations introduced by TALEN pair TaSBEIIa_T02

SEQ ID NO: 1479 - DNA, 653 bp, Artificial
  TaSBEIIa-A allele with mutations introduced by TALEN pair TaSBEIIa_T02
  misc_feature (424): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaggtggcacttttcggggaaatgtgcgcggaacccctatttgtttattttttctaaatacaaacccaacagacactttcggagatacccatagtttcaacacactcatacgaaagttttattatttaggccaccacttcaagaactctgtagcaccttcggtcctccgatcgttgtcagaagtaagttacaatcactgatggtgtaaccaaaggagttaaggaactagtcgtgggggngaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 1480 - DNA, 588 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaactgacaggggggactgcagaaaaacttgaatcttcagaaccgactcaaggcattgaagcattttttgacaagaaatatttgctagctgatagtgaccttaggcgacttttgaacgcggtccagcggctgttgccggtgctgtgccaggcccacggcttgaccccggagcaggtggtggccatcgccagcaatattggtggtatccggtaagcggcagggtcggaacaggagagcgcacgaggggagcttccaccttcatctccaggatacggtcctgggtgctgttccgggcgatctcgatcagctcgaacaatcactgatggtgtaaccaaaggagttaaggaactagtcgtgggggagaaaccgcgagttgtcccaaaaccaggagatgggcagaaaaatatacgagattgacccaacgctgaagattttcggagccatcttgactaccggtaat

SEQ ID NO: 1481 - DNA, 556 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattcttcaattcttcaacggtagcttcacggttcggttcactcccatcaaagaattcaccttgcaagccaatacacacaatagcccaaacggcggggttatgtccatgaatatgcattttcatcttatgcttccaactagcaaaataacaatcactgatggtgtaaccaaaggagttaaggaactagtcgtgggggagaaaccgcgagttgtcccaaaaaccaggagatgggcagaaaaatatacgagattgacccaacgctgaaaagatttttcggagccatcttgactaccggtaatgcctacccgctactttcgctcatttgaattaaggtcctttcgtcatgcaaatttggggaacatcaaagagacaaa

SEQ ID NO: 1482 - DNA, 434 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagatggtgtaaccaaaggagttaaggaactagtcgtgggggagaaaccgcgagttgtcccaaaaaccaggagatggggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgc

SEQ ID NO: 1483 - DNA, 684 bp, Artificial
  TaSBEIIa-A allele with mutations introduced by TALEN pair TaSBEIIa_T02
  misc_feature (431): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaagcattttttgacaagaaatatttgctagctgatagtgaccttaggcgacttttgaacgcggtccagcggctgttgccggtgctgtgccaggcccacggcttgaccccggagcaggtggtggccatcgccagcaatattggtggtatccggtaagcggcagggtcggaacaggagagcgcacgagggagcttccaccttcatctccaggatacggtcctgggtgctgttccgggcgactcgatnagctcgaacaatcactgatgtgtaaccaaaggagttagaactagtcgtgggggagaaccgcgagttgtcccaaaaccaggagatgggcagaaaatatacgagattgaccaacgctgaagattttcggagccatcttgactaccggtaaatgcctacccgctactttcgctcattttgaattaaggtcctttcgtcatgcaaattttgggaacatcaaaagagacaagactagggaccactatttcttacagtt

SEQ ID NO: 1484 - DNA, 463 bp, Artificial; identical to SEQ ID NO: 1055
  TaSBEIIa-A allele with mutations introduced by TALEN pair TaSBEIIa_T02

SEQ ID NO: 1485 - DNA, 467 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 1486 - DNA, 478 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaaacggctgaagtaaacatgacagggggactgcagaaaaacttgaatcttcagaaccgactcaaggcataaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctaaccccgctacttttcgctcatttttgaattaaggtccttttcgtcaatgcaaaattttgggggaacatcaaaagagacaaaagactaggggaccactattttcttacagttccccctcatggtctgagaaatatgc

SEQ ID NO: 1487 - DNA, 697 bp, Artificial
  TaSBEIIa-A allele with mutations introduced by TALEN pair TaSBEIIa_T02
  misc_feature (238); (368): n is a or c or t or g
agatggatgtgcattctagcaagaacttcacgaaataatgcactgttttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaaagccgctggaccgtctccagcgcctgcttgccaccgccattgctggcnatggccaccacctgctgggggggtcaagccgtgggcctggcacagcaccggcaacagcgcctgcaccgtctccagcgcctgcttgccaccaatattgctggcgatggccaccacctgctccggggtcaanccgtgggcctggcacagcaccgggcaacagccgctgggagacgagctgcattaatgaatcggccaacgcgcggggagaggcggtttgcgtattgggcgctcttccgcttcctcgctcaactgactcgctgcgctcggtgcgtcggctgcggcgagcggtatcagctcactcaaaggcggtaatactgcaatcactgatggtgtaaccaaaggagttaatggaagctagtccgtggggggagaaaaccgcgagttgtcccaaaaagccaaggagatggggcaaggaaaagtaatacgagattgacccaacgctgaaagattttcggagcc

SEQ ID NO: 1488 - DNA, 458 bp, Artificial; identical to SEQ ID NO: 1176
  TaSBEIIa-A allele with mutations introduced by TALEN pair TaSBEIIa_T02

SEQ ID NO: 1489 - DNA, 485 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaacttgaatcttcagaaccgactcaagggcaaacaatcactgatggtgtaaccaaaagggagttaaggaactagtcgtggggggagaaaccgcgagttgtcccaaaaccaggagatggggcagaaaaaatatacgagattgacccaacgctgaaagatttttcggagccatcttgactaccggtaatgcctacccgctactttcgctcatttttgaattaaggtcctttcgtcatgcaaaattttgggggaaaccatcaaaagagacaaaagactaggggaccactattttcttacagtttccccctcatggtctgagaaatatgctggg

SEQ ID NO: 1490 - DNA, 468 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaacaatcactgatggtgtaaccaaaggagttaaggaactagtcgtgggggagaaaccgcgagttgtcccaaaaaccaggagatggggcagaaaaatatacgagattgacccaacgctgaaagattttcggagccatcttgactaccggtaatgcctacccgctactttcgctcattttgaattaaggtcctttcatcatgcaaaattttggggaacatcaaagagacaaaagactagggaccaccatttcatacagatcccctcgtggtctgagaatatgctggga

SEQ ID NO: 1491 - DNA, 407 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaccgcgagtttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgc

SEQ ID NO: 1492 - DNA, 459 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcatatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctaattctgctcattttgaattaaggtcctttcatcatagcaatttgggggaacatcaaagaggcaaagactagggaccactatttcatacagttcccctcatggtctgagaatatgct

SEQ ID NO: 1493 - DNA, 876 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgccaggatacggtcctgggtgctgttccgggcgatctcgatcagctcgagctcacgctgtaggtatctcagttcggtgtaggtcgttcgctccaagctgggctgtaataaaccagccagccggaagggccgagcgcagaagtggtcctgcaactttatccgcctccatccagtctattaattgttgccgggaagctagagttcttgaagtggtggcctaactacggctacactagaagaacagtatttggtatctgcgctctgctgaagccagttaccttcggaaaaagagttggtagctcttgatccaactgtaacggtggacctctcaactctcccgccaccgtgagcaaggccaacagttgcgcagcctgaatggcgaatggcgcctgatgcggtattttctccttacgcatctgtgcgcggtggtttgttgccggatcaagagctaccaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccggctactttcgctcatttgaaattaaaggtcctttcggtcatgcaaaatttggggaacatcaaagagacaaagactagggaccac

SEQ ID NO: 1494 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcaaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaattttgggggaacatcaaagagacaaagactagggaccactatttcttacagttcccctcatggtctgagaatatgct

SEQ ID NO: 1495 - DNA, 461 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatatctgaagacatcgaggagcaaacggctgaagtaaacatgacaggggggactgcagaaaaacttgaatcttcagaaccgactcaaggcaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1496 - DNA, 406 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaccgcgagttgtcccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgc

SEQ ID NO: 1497 - DNA, 463 bp, Artificial; identical to SEQ ID NO: 993
  TaSBEIIa-A allele with mutations introduced by TALEN pair TaSBEIIa_T02

SEQ ID NO: 1498 - DNA, 512 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgacactttatgcttccggctcgtatgttgtgtggaattgtgagcggaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaaagagacaaaagactagggaccactatttcttacagttcccctcatggtctgagaatatgct

SEQ ID NO: 1499 - DNA, 407 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaccgcgagttgtccccaaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgc

SEQ ID NO: 1500 - DNA, 509 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggtagctttccgccgcctgcgcttccagcaattccgactcttcaataacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1501 - DNA, 819 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaaagccgctggaccgtctccagcgcctgcttgccaccgccattgctggcgatggccaccacctgctgggggggtcaagccgtgggcctggcacagcaccggcaacagcgcctgcaccgtctccagcgcctgcttgccaccaatattgctggcgatggccaccacctgctccggggtcaagccgtgggcctggcacagcaccggcaacaggcgctggagacgagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacgcaatcactgtggtgtaaccaaagggttaagaactagtcgtggggggagaaaaccgcgagttgtcccaaaaccggagatggggcagaaaataatacgagattggacccaacgctgaaagattttcggagccaatcttgactaccggtaatgcctacccgcactttcggctcatttgaattaaggtcctttcgtcatgcaaatttggggaactcaaagagacaaagactagggaccactattcttacagttcccctcatggtctgagaatat

SEQ ID NO: 1502 - DNA, 815 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgccaggatacggtcctgggtgctgttccgggcgatctcgatcagctcgagctcacgctgtaggtatctcagttcggtgtaggtcgttcgctccaagctgggctgtaataaacagccagccggaagggccgagcgcagaagtggtcctgcaactttatccgcctccatccagtctattaattgttgccgggaagctagagttcttgaagtggtggcctaactacggctacactagaagaacagtatttggtatctgcgctctgctgaagccagttaccttcggaaaaagagttggtagctcttgatccaactgtaacggtggacctctcaactctcccgccaccgtgagcaaggccaacagttgcgcagcctgaatggcgaatggcgcctgatgcggtattttctccttacgcatctgtgcgcggtggtttgttgccggatcaagagctaccaatcactgatggtgtaaccaaaggagttaaggaactagtcgtgggggagaaaccgcgagttgtcccaaaaccaggagatgggcagaaaatatacgagattgacccaaacgctgaaaagattttcggagccatcttgactaccggtaatgcctacccgctactttcgctcatttgaaatt

SEQ ID NO: 1503 - DNA, 464 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatataatcactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccccctcatggtctgagaatatgct

SEQ ID NO: 1504 - DNA, 463 bp, Artificial; identical to SEQ ID NO: 993
  TaSBEIIa-A allele with mutations introduced by TALEN pair TaSBEIIa_T02

SEQ ID NO: 1505 - DNA, 462 bp, Artificial; identical to SEQ ID NO: 1342
  TaSBEIIa-A allele with mutations introduced by TALEN pair TaSBEIIa_T02

SEQ ID NO: 1506 - DNA, 462 bp, Artificial
  TaSBEIIa-A allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagacatcgaggagcaaacggctgaagtaaacatgacagggggactgcagaaaaacttgaatcttcagaaccgactcaaggcactgatggtgtaaccaaaggagttaaggaactagtcgtggggggagaaaaccgcgagttgtcccaaaaaccaggagatgggcagaaaatatacgagattgacccaacgctgaaagattttcggagccatcttgactaccggtaatgcctacccgctactttcgctcattttgaaattaaggtcctttcgtcatgcaaatttggggaacatcaaagagacaaagactagggaccactattttcttacagttcccctcatggtctgagaatatgctggga

SEQ ID NO: 1507 - DNA, 456 bp, Artificial
  TaSBEIIa-A allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccccctcatggtctgag

SEQ ID NO: 1508 - DNA, 550 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcttcaattcttcaacggtagcttcacggttcggttcactcccatcaaagaattcaccttgcaagccaatacacacaatagcccaaacggcgggggttatgtccatgaatatgcattttcatcttatgcttccaactagcaaaataacaatcactgatggtgtaaccaaaggagttaaggaactagtcgtgggggagaaaccgcgagttgtcccaaaaaccaggagatgggcagaaaaatatacgagattgacccaacgctgaaagatttttcggagccatcttgactaccggtaatgcctacccgctactttcgctcatttgaattaaggtcctttcgtcatgcaaatttggggaacatcaaag

SEQ ID NO: 1509 - DNA, 450 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattggtgtaaccaaaggagttaaggaactagtcgtggggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactattttcttacagttccccctcatggtctgagaatatg

SEQ ID NO: 1510 - DNA, 470 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattacaatcactgatggtgtaaccaaaggagttaaggaactagtcgtggggggagaaaccgcgagttgtcccaaaaccaggagatggggcagaaaaatatacgagattgacccaacgctgaaagattttcggagccatcttgactaccggtaatgcctacccgctacttttcgctcattttgaattaaggtcctttcgtcatgcaaatttggggaacatcaaagagacaaagactaggggaccactatttcttacagttccccctcatggtctgagaatatgctggg

SEQ ID NO: 1511 - DNA, 457 bp, Artificial
  TaSBEIIa-A allele with mutations introduced by TALEN pair TaSBEIIa_T02
  misc_feature (192): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcataacacacntggtgtaaccaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1512 - DNA, 632 bp, Artificial
  TaSBEIIa-A allele with mutations introduced by TALEN pair TaSBEIIa_T02
  misc_feature (601): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaagcattttttgacaagaaatatttgctagctgatagtgaccttaggcgacttttgaacgcggtccagcggctgttgccggtgctgtgccaggcccacggcttgaccccggagcaggtggtggccatcgccagcaatattggtggtatccggtaagcggcagggtcggaacaggagagcgcacgaggggagcttccaccttcatctccaggatacggtcctgggtgctgttccgggcgatctcgatcagctcgaacaatcactgatggtgtaaccaaaggagttaaggaactagtcgtgggggagaaaccgcgagttgtccccaaaaacccaggagatgggcagaaaaatatacgagattgacccaacgctgaagattttcggagccatcttgactaccggtaatgcctacccgntactttcgctcattttgaattaaggtccttt

SEQ ID NO: 1513 - DNA, 576 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcttcaattcttcaacggtagcttcacggttcggttcactccccatcaaagaattcaccttgcaagccaatacacacaatagcccaaacggcgggggttatgtccatgaatatgcattttcatcttatgcttccaactagcaaaataacaatcactgatggtgtaaccaaaggagttaaggaactagtcgtgggggagaaaccgcgagttgtcccaaaaccaggagatgggcagaaaatatacgagattgaccccaacgctgaaagattttcggagccatcttgactaccggtaatgcctacccgctactttcgctcattttgaattaaggtcctttcgtcatgcaaatttggggaacatcaaagagacaaagactagggaccactatttc

SEQ ID NO: 1514 - DNA, 462 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1515 - DNA, 465 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccccctcatggtctgagaatatgct

SEQ ID NO: 1516 - DNA, 466 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaaagactagggaccactatttcttacagttcccctcatggtctgagaatatgct

SEQ ID NO: 1517 - DNA, 463 bp, Artificial; identical to SEQ ID NO: 993
  TaSBEIIa-A allele with mutations introduced by TALEN pair TaSBEIIa_T02

SEQ ID NO: 1518 - DNA, 469 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaacaatcactgatggtgtaaccaaaggagttaaggaactagtcgtggggggagaaaccgcgagttgtcccaaaaccaggagatggggcagaaaaatatacgagattgacccaacgctgaaagattttcggagccatcttgactacccggtaatgcctacccgctacttttcgctcatttttgaattaaggtccttttcgtcatgcaaattttggggaacatcaaagaggcaaagactagggaccactattttcatacagttccccctcatggtctgagaatatgct

SEQ ID NO: 1519 - DNA, 412 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaccgcgagtttgtccccaaaaaccagggagatggggcagaaaaatatacgagattgacccaacgctgaaagatttttcggagccatcttgactaccggtaaatgcctacccgctactttcgctcattttgaattaaggtcctttcgtcatgcaaatttggggaacatcaaagagacaaagactagggaccactatttcttacagttcccctcatggtctgagaatatgc

SEQ ID NO: 1520 - DNA, 676 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaaagccgctggaccgtctccagcgcctgcttgccaccgccattgctggcgatggccaccacctgctgggggggtcaagccgtgggcctggcacagcaccggcaacagcgcctgcaccgtctccagcgcctgcttgccaccaatattgctggcgatggccaccacctgctccggggtcaagccgtgggcctggcacagcaccggcaacagccgctggagacgagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacgcaatcactgtggtgtaaccaaagggttaaggaactagtcgtggggggagaaaaccgcgagttgtcccaaaaccggagatggggcagaaaataatacgagattggacccaacgctgaaagatttttc

SEQ ID NO: 1521 - DNA, 619 bp, Artificial
  TaSBEIIa-A allele with mutations introduced by TALEN pair TaSBEIIa_T02
  misc_feature (596): n is a or c or t or g
agatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgaagcattttttgacaagaaatatttgctagctgatagtgaccttaggcgacttttgaacgcggtccagcggctgttgccggtgctgtgccaggcccacggcttgaccccggagcaggtggtggccatcgccagcaatattggtggtatccggtaagcggcagggtcggaacaggagagcgcacgaggggagcttccaccttcatctccaggatacggtcctgggtgctgttccgggcgatctcgatcagctcgaacaatcactgatggtgtaaccaaaggagttaaggaactagtcgtgggggagaaaccgcgagttgtcccaaaaccaggagatgggcagaaaaatatacgagattgaccaacgctgaagattttcggagccacttgactaccggtaatgcctacccgntactttcgctcattttgaattaa

SEQ ID NO: 1522 - DNA, 442 bp, Artificial
  TaSBEIIa-A allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctaccccgctactttcgctcattttgaattaaggtcctttcgtcatgcaaattttggggaacatcaaagagacaaagactaggggacccactattttctta

SEQ ID NO: 1523 - DNA, 449 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattcaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggt

SEQ ID NO: 1524 - DNA, 465 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgaacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1525 - DNA, 462 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1526 - DNA, 461 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgct

SEQ ID NO: 1527 - DNA, 461 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaggcaacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgatagatatgct

SEQ ID NO: 1528 - DNA, 519 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtgggtcggaacaggagagcgcacgagggagcttccagggggaaacgcctggtaaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1529 - DNA, 465 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattaacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgct

SEQ ID NO: 1530 - DNA, 410 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaaacggctgaagtgaacatgacaggggggaccgcagagaaacttgaatcttcagaaccgactcagggcatgactgatggtgtaaccaaaggagttaaggaactagtcgcggggagaaaccgcgagttgtcccaaaaccaggagatgggcagaaaatatacgagattgacccaacgctgaaagattttcggagccatcttgatctaccggtaatgcctacccgctaatttcgctcattttgaattaaggtcctttcatcatgcaaatttggggaacatcaaagaggcaaaga

SEQ ID NO: 1531 - DNA, 518 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattggctctctctatttatagaggccatggtcctcttccaaaatattgagtgggaaaacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcatttttgaattaaggtcctttcatcatgcaaatttggggaacatcaaagaggcaaagactagggaccactatttcatacagttcccctcatggtctgagaatatgct

SEQ ID NO: 1532 - DNA, 417 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggggaccgcagagaaacttgaatcttcagaaccgactcagggcatacaatcactgatggtgtaaccaaaggagttaaggaactagtcgcggggagaaaccgcgagttgtcccaaaaccaaggagatgggcagaaaataatacgagattgacccaacgctgaaagattttcggagccatcttgatctaccggtaatgcctacccgctaatttcgctcattttgaattaaggtcctttcatcatgcaaatttggggaacatcaaatgaggcaaag

SEQ ID NO: 1533 - DNA, 549 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacgggccgagtgaaagtcgaatgacaatgggggaccgcaagggggaagaaccttggcaaagagtaaacctttgcaaatgcaattcccgaacgtcaaaccggggcaactttcgatgggggcaaaattgtggcaaaaacaattccaaccttggaatggggttggttaaacccaaaagggagttaaagggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgct

SEQ ID NO: 1534 - DNA, 468 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtaaacaatcactgatggtgtaaccaaaggagttaaggaactagtcgcggggagaaaccgcgagttgtcccaaaaccaggagatgggcagaaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1535 - DNA, 453 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1536 - DNA, 454 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1537 - DNA, 418 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggggaccgcagagaaacttgaatcttcagaaccgactcaagggcatgaacatcactgatggtgtaaccaaaggagttaaggaactagtcgctggggagaaaccgcgagttgtcccaaaaccaaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaaga

SEQ ID NO: 1538 - DNA, 457 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgagcatgacagggggaccgcagagaaacttgaatcttcagaaccgactcagggcatgactgatggtgtaaccaaaggagttaaggaactagtcgcggggagaaaccgcgagttgtcccaaaaccaggagatgggcagaaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1539 - DNA, 451 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaacaatcactgatggtgtaaccaaaggagttaaggaactagtcgcgggggagaaaccgcgagttgtcccaaaaccaggagatggggcagaaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1540 - DNA, 460 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1541 - DNA, 519 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtgggtcggaacaggagagcgcacgagggagcttccagggggaaacgcctggtaaacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaattttggggaacatcaaagaggcaaagactagggaccactatttcatacagttcccctcatggtctgagaatatgct

SEQ ID NO: 1542 - DNA, 507 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtgatcggatcccgggcccgtcgactgcagaggcctgcatgcaagcttggcgtaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctatttcgctcattttgaattaaggtcctttcatcatgcaaatttgggaacatcaaagaggcaaagactagggaccactatttcatacagttcccctcatggtctgagaatg

SEQ ID NO: 1543 - DNA, 457 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcatgactgatggtgtaaccaaaggagttaaggaactagtcgcggggagaaaccgcgagttgtcccaaaaccaggagatgggcagaaaatatacgagattgacccaacgctgaaagattttcggagccatcttgaactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1544 - DNA, 396 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtgggtcggaacaggagagcgcacgagggagcttccagggggaaacgcctggtaaacaatcactgatggtgtaaccaaaggagttaaggaactagtcgcggggagaaaccgcgagttgtcccaaaaccaggagatgggcagaaaatatacgagattgacccaacagctgaaagattttcggagccatcttgactaccggtaatgcct

SEQ ID NO: 1545 - DNA, 518 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattggctctctctatttatagaggccatggtcctcttccaaaatattgagtgggaaaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1546 - DNA, 461 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcacaatcactgatggtgtaaccaaaggagttaaggaactagtcgcggggagaaaccgcgagttgtcccaaaaccaggagatgggcagaaaatatacgagattgacccaacgctgaaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1547 - DNA, 511 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtgatcggatcccgggcccgtcgactgcagaggcctgcatgcaagcttggcgtaatcactgatggtgtaaccaaaggagttaaggaactagtcgcgggggagaaaccgcgagttgtcccaaaaccaggagatgggcagaaaatatacgagattgacccaacgctgaaagattttcggagccattctgactaccggtaaatgcctacccgctaatttcgctcattttgaattaaggtcctttcatcatgcaaatttgggaacatcaaagagacaaagactagggaccactatttcttacagttcccctcatggtctgagaata

SEQ ID NO: 1548 - DNA, 457 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatgactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1549 - DNA, 463 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1550 - DNA, 462 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattcaatcactgatggtgtaaccaaaggagttaaggaactagtcgcggggagaaaccgcgagttgtcccaaaaccaggagatgggcagaaaatatacgagattgacccaacgctgaaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1551 - DNA, 462 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattcaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1552 - DNA, 465 bp, Artificial
  TaSBEIIa-B allele with mutations introduced by TALEN pair TaSBEIIa_T02
agatggatgtgcattctagcaagaacttcacaaaataatgcactgtttgtggtttcgttgtctgctctacgattgctatttttcgtgtgctgtagatacctgaagatatcgaggagcaaacggctgaagtgaacatgacaggggggaccgcagagaaacttgaatcttcagaaccgactcagggcattgaacaatcactgatggtgtaaccaaaggagttaaggaactagtcgcggggagaaaccgcgagttgtcccaaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1553 - DNA, 454 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtgatggtgtaaccaaaggagttaaggaactagtcgcggggagaaaccgcgagttgtcccaaaaaccaggagatgggcagaaaaatatacgagattgacccaacgctgaaaagattttcggagccatcttgactaccggtaatgcctaacccgctaaatttcgctcattttgaattaaggtcctttcatcatgcaaaatttggggaacatcaaagaggcaaaagactagggaccactaatttcatacagttcccctcatggtctg

SEQ ID NO: 1554 - DNA, 460 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaggcaacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1555 - DNA, 468 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtaagcaaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1556 - DNA, 449 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaat

SEQ ID NO: 1557 - DNA, 556 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcagatccggcgttggccgcgttgaccaacgaccacctcgtcgccttggcctgcctcggcgggcgtcctgcgctggatgcagtgaaaaagggacaatcactgatggtgtaaccaaaggagttaaggaactagtcgcgggggagaaaccgcgagttgtcccaaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 1558 - DNA, 460 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgaacaatcactgatggtgtaaccaaaggagttaaggaactagtcgcggggagaaaccgcgagttgtcccaaaaccaggagatgggcagaaaatatacgagattgacccaacgctgaaaagattttcggagccatcttgactaccggtaatgcctacccgctaattcgctcattttgaattaaggtcctttcatcatgcaaatttggggaacatcaaagaggcaaagactagggaccactatttcatacagttcccctcatggtctgagaat

SEQ ID NO: 1559 - DNA, 460 bp, Artificial; identical to SEQ ID NO: 1554
  TaSBEIIa-B allele with mutations introduced by TALEN pair TaSBEIIa_T02

SEQ ID NO: 1560 - DNA, 460 bp, Artificial; identical to SEQ ID NO: 1554
  TaSBEIIa-B allele with mutations introduced by TALEN pair TaSBEIIa_T02

SEQ ID NO: 1561 - DNA, 517 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattggctctctctatttatagaggccatggtcctcttccaaaatattgagtgggaaaacaatcactgatggtgtaaccaaaggagttaaggaactagtcgcggggagaaaccgcgagttgtcccaaaaccaggagatgggcagaaaatatacgagattgacccaacgctgaaagattttcgggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1562 - DNA, 457 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcatgactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaattttcgctcattttgaattaaggtcctttcatcatgcaaatttggggaacatcaaagaggcaaagactagggaccactatttcatacagttcccctcatggtctgagaatatgct

SEQ ID NO: 1563 - DNA, 465 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattaacaatcactgatggtgtaaccaaaggagttaaggaactagtcgcggggagaaaccgcgagttgtcccaaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1564 - DNA, 468 bp, Artificial; identical to SEQ ID NO: 1534
  TaSBEIIa-B allele with mutations introduced by TALEN pair TaSBEIIa_T02

SEQ ID NO: 1565 - DNA, 460 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1566 - DNA, 464 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagagacaaagactagggaccaccatttcatacagatcccctcgtggtctgagaatatgctggga

SEQ ID NO: 1567 - DNA, 463 bp, Artificial
  TaSBEIIa-B allele with mutations introduced by TALEN pair TaSBEIIa_T02
agatggatgtgcattctagcaagaacttcacaaaataatgcactgtttgtggtttcgttgtctgctctacgattgctatttttcgtgtgctgtagatacctgaagatatcgaggagcaaacggctgaagtgaacatgacagggggggaccgcagagaaacttgaatcttcagaaccgactcagggcattgaacaatcactgatggtgtaaccaaaggagttaaggaactagtcgcgggggagaaaccgcgagttgtcccaaaaccaggagatgggcagaaaatatacgagattgacccaacgctgaaaagatttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaat

SEQ ID NO: 1568 - DNA, 461 bp, Artificial; identical to SEQ ID NO: 1526
  TaSBEIIa-B allele with mutations introduced by TALEN pair TaSBEIIa_T02

SEQ ID NO: 1569 - DNA, 467 bp, Artificial
  TaSBEIIa-B allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagacatcgaggagcaaacggctgaagtgaacatgacagggggaccggcagagaaacttgaatcttcagaaccgactcagggcattgtaaacaatcactgatggtgtaaccaaaggagttaaggaactagtcgcgggggagaaaccgcgagttgtcccaaaaccaggagatggggcagaaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1570 - DNA, 466 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcaaaaacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactatttcatacagttccccctcatggtctgagaatatgct

SEQ ID NO: 1571 - DNA, 457 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1572 - DNA, 460 bp, Artificial; identical to SEQ ID NO: 1540
  TaSBEIIa-B allele with mutations introduced by TALEN pair TaSBEIIa_T02

SEQ ID NO: 1573 - DNA, 470 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtaaacaatcactgatggtgtaaccaaaggagttaaggaactagtcgcggggagaaaccgcgagttgtcccaaaaaccaggagatgggcagaaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgct

SEQ ID NO: 1574 - DNA, 518 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtgggtcggaacaggagagcgcacgagggagcttccagggggaaacgcctggtaaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1575 - DNA, 462 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatggacaggggggaccgcagagaaacttgaatcttcagaaccgactcagggcataatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgct

SEQ ID NO: 1576 - DNA, 464 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataaacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1577 - DNA, 465 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcatggaaacatcactgatggtgtaaccaaaggagttaaggaactagtcgcggggagaaaccgcgagttgtcccaaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1578 - DNA, 464 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcaaaacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgct

SEQ ID NO: 1579 - DNA, 466 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaattttcgctcattttgaattaaggtcctttcatcatgcaaatttggggaacatcaaagaggcaaagactagggaccactatttcatacagttcccctcatggtctgagaatatgct

SEQ ID NO: 1580 - DNA, 464 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgct

SEQ ID NO: 1581 - DNA, 521 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtgggtcggaacaggagagcgcacgagggagcttccagggggaaacgcctggtaaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccgggtaaatgcctacccgctaatttcgctcatttttgaattaaggtcctttcatcatgcaaatttggggaacatcaaagaggcaaagactagggaccactatttcatacagttcccctcatggtctgagaatatgct

SEQ ID NO: 1582 - DNA, 465 bp, Artificial; identical to SEQ ID NO: 1524
  TaSBEIIa-B allele with mutations introduced by TALEN pair TaSBEIIa_T02

SEQ ID NO: 1583 - DNA, 464 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataacaatcactgatggtgtaaccaaaggagttaaggaactagtcgcggggagaaaccgcgagttgtcccaaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1584 - DNA, 416 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtaaacaatcactgatggtgtaaccaaaggagttaaggaactagtcgcggggagaaaccgcgagttgtcccaaaaccaaggagatgggcagaaaatatacgagattgacccaacgctgaaagattttcggagccatcttgactaccggtaatgcctacccgctaatttcgctcattttgaattaaggtcctttcatcatgcaaatttggggaacacaaatgaggcaa

SEQ ID NO: 1585 - DNA, 462 bp, Artificial; identical to SEQ ID NO: 1525
  TaSBEIIa-B allele with mutations introduced by TALEN pair TaSBEIIa_T02

SEQ ID NO: 1586 - DNA, 460 bp, Artificial; identical to SEQ ID NO: 1554
  TaSBEIIa-B allele with mutations introduced by TALEN pair TaSBEIIa_T02

SEQ ID NO: 1587 - DNA, 458 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1588 - DNA, 462 bp, Artificial; identical to SEQ ID NO: 1525
  TaSBEIIa-B allele with mutations introduced by TALEN pair TaSBEIIa_T02

SEQ ID NO: 1589 - DNA, 516 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtgatcggatcccgggcccgtcgactgcagaggcctgcatgcaagcttggcgtaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaattttggggaacatcaaagaggcaaagactagggaccactatttcatacagttcccctcatggtctgagaatatgct

SEQ ID NO: 1590 - DNA, 515 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaagatgacaggggggaccgcagagaaacttgaatcttcagaaccgactcagggcattgtgatcggatccccgggcccgtcgactgcagaggcctgcatgcaagcttggcgtaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgct

SEQ ID NO: 1591 - DNA, 465 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1592 - DNA, 468 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgaacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactattttcatacagttccccctcatggtctgagaatatgct

SEQ ID NO: 1593 - DNA, 460 bp, Artificial; identical to SEQ ID NO: 1540
  TaSBEIIa-B allele with mutations introduced by TALEN pair TaSBEIIa_T02

SEQ ID NO: 1594 - DNA, 461 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcaggcaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1595 - DNA, 463 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatacaatcactgatggtgtaaccaaaggagttaaggaactagtcgcggggagaaaccgcgagttgtcccaaaaccaggagatgggcagaaaatatacgagattgacccaacgctgaaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1596 - DNA, 457 bp, Artificial; identical to SEQ ID NO: 1548
  TaSBEIIa-B allele with mutations introduced by TALEN pair TaSBEIIa_T02

SEQ ID NO: 1597 - DNA, 466 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataaacaatcactgatggtgtaaccaaaggagttaaggaactagtcgcggggagaaaccgcgagttgtcccaaaaccaggagatgggcagaaaaatatacgagattgacccaacgctgaaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1598 - DNA, 462 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgct

SEQ ID NO: 1599 - DNA, 463 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattcaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgct

SEQ ID NO: 1600 - DNA, 458 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatgactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttccccctcatggtctgagaatatgct

SEQ ID NO: 1601 - DNA, 422 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaaacggctgaagtgaacatgacaggggggaccgcagagaaacttgaatcttcagaaccgactcagggcatacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggga

SEQ ID NO: 1602 - DNA, 466 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcaatggaaacatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1603 - DNA, 556 bp, Artificial; identical to SEQ ID NO: 1557
  TaSBEIIa-B allele with mutations introduced by TALEN pair TaSBEIIa_T02

SEQ ID NO: 1604 - DNA, 405 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaaga

SEQ ID NO: 1605 - DNA, 465 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactattttcatacagttccccctcatggtctgagaatatgct

SEQ ID NO: 1606 - DNA, 463 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatacaatcactgatggtgtaaccaaaggagttaaggaactagtcgcggggagaaaccgcgagttgtcccaaaaccaggagatgggcagaaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1607 - DNA, 468 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattagcaaacatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgct

SEQ ID NO: 1608 - DNA, 517 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtgatcggatcccggggcccgtcgactgcagaggcctgcatgcaagcttggcgtaatcactgatggtgtaaccaaaggagttaaggaactagtcgcgggggagaaaccgcgagttgtcccaaaaccaggagatgggcagaaaatatacgagattgacccaacgctgaaagattttcggagccaattctgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1609 - DNA, 518 bp, Artificial; identical to SEQ ID NO: 1545
  TaSBEIIa-B allele with mutations introduced by TALEN pair TaSBEIIa_T02

SEQ ID NO: 1610 - DNA, 528 bp, Artificial
  TaSBEIIa-B allele with mutations introduced by TALEN pair TaSBEIIa_T02
  misc_feature (400): n is a or c or t or g
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtgggtcggaacaggagagcgcacgagggagcttccagggggaaacgcctggtaaacaatcactgatggtgtaaccaaaaggagttaaggaactagtcgcgggggagaaaccgcgagttgtcccaaaaaccaggagatgggcagaaaaatatacgagattgacccaacgctgaaagattttcggagccatcttgactaccggtaaatgccnacccgctaatttcgctcattttgaattaaggtcctttcgatcatgcaaaattttggggaacttcaaaagaggccaaagactagggaccactattcatacagttcccctcatggtctgagaatatcgct

SEQ ID NO: 1611 - DNA, 458 bp, Artificial; identical to SEQ ID NO: 1600
  TaSBEIIa-B allele with mutations introduced by TALEN pair TaSBEIIa_T02

SEQ ID NO: 1612 - DNA, 468 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaaacggctgaagtgaacatgacaggggggaccgcagagaaacttgaatcttcagaaccgactcagggcataaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactatttcatacagttccccctcatggtctgagaatatgct

SEQ ID NO: 1613 - DNA, 463 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattcaatcactgatggtgtaaccaaaggagttaaggaactagtcgcggggagaaaccgcgagttgtcccaaaaccaggagatgggcagaaaatatacgagattgacccaacgctgaaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1614 - DNA, 557 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcagatccggcgttggccgcgttgaccaacgaccacctcgtcgccttggcctgcctcggcgggcgtcctgcgctggatgcagtgaaaaagggacaatcactgatggtgtaaccaaaggagttaaggaactagtcgcgggggagaaaccgcgagttgtcccaaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccacttatttcatacagttcccctcatggtctgagaatatgctggga

SEQ ID NO: 1615 - DNA, 556 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcagatccggcgttggtcgcgttgaccaacgaccacctcgtcgccttggcctgcctcggcgggcgtcctgcgctggatgcagtgaaaaagggacaatcactgatggtgtaaccaaaggagttaaggaactagtcgcgggggagaaaccgcgagttgtcccaaaaaccaggagatgggcagaaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 1616 - DNA, 463 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattcaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactattttcatacagttcccctcatggtctgagaatatgct

SEQ ID NO: 1617 - DNA, 462 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgaacatcagatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1618 - DNA, 469 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtaaacaatcactgatggtgtaaccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactattttcatacagttcccctcatggtctgagaatatgct

SEQ ID NO: 1619 - DNA, 518 bp, Artificial
  TaSBEIIa-B allele with mutations introduced by TALEN pair TaSBEIIa_T02
agatggatgtgcattctagcaagaacttcacaacataatgcaccgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtgggtcggaacaggagagcgcacgagggagcttccagggggaaacgcctggtaaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1620 - DNA, 460 bp, Artificial; identical to SEQ ID NO: 1554
  TaSBEIIa-B allele with mutations introduced by TALEN pair TaSBEIIa_T02

SEQ ID NO: 1621 - DNA, 456 bp, Artificial
  TaSBEIIa-B allele with mutations introduced by TALEN pair TaSBEIIa_T02
  misc_feature (177): n is a or c or t or g
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccnactcagggcatacaatcactgatggtgtaaccaaaggagttaaggaactagtcgcggggagaaaccgcgagttgtcccaaaaaccaggagatgggcagaaaaatatacgagattgacccaacgctgaaaagattttcggagccatcttgaactaccggtaatgcctacccgctaatttcgctcattttgaattaaggtcctttcatcatgcaaatttggggaacatcaaagaggcaaagactagggaccactatttcatacagttcccctcatggtctg

SEQ ID NO: 1622 - DNA, 462 bp, Artificial; identical to SEQ ID NO: 1598
  TaSBEIIa-B allele with mutations introduced by TALEN pair TaSBEIIa_T02

SEQ ID NO: 1623 - DNA, 461 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcaatcactgatggtgtaaccaaaggagttaaggaactagtcgcggggagaaaccgcgagttgtcccaaaaccaggagatgggcagaaaaatatacgagattgacccaacgctgaaagattttcggagccatcttgactaccggtaatgcctacccgctaatttcgctcattttgaattaaggtcctttcatcatgcaaattttggggaacatcaaagaggcaaagactagggaccactatttcatacagttccccctcatggtctgagaatatgct

SEQ ID NO: 1624 - DNA, 516 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtgatcggatcccgggcccgtcgactgcagaggcctgcatgcaagcttggcgtaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcatttttgaattaaggtcctttcatcatgcaaatttggggaacatcaaagaggcaaagactagggaccactatttcatacagttcccctcatggtctgagaatatgct

SEQ ID NO: 1625 - DNA, 520 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtgggtcggaacaggagagcgcacgagggagcttccagggggaaacgcctggtaaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccgggtaatgcctacccgctaatttcgctcattttgaattaaggtcctttcatcatgcaaatttggggaacatcaaagaggcaaagactagggaccactatttcatacagttcccctcatggtctgagaatatgct

SEQ ID NO: 1626 - DNA, 466 bp, Artificial
  TaSBEIIa-B allele with mutations introduced by TALEN pair TaSBEIIa_T02
agatggatgtgcattctagcaagaacttcacaaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgaacatcacgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttccccctcatggtctgagaatatgct

SEQ ID NO: 1627 - DNA, 464 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatacaatcactgatggtgtaaccaaaggagttaaggaactagtcgcggggagaaaccgcgagttgtcccaaaaccaggagatgggcagaaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttccccctcatggtctgagaatatgct

SEQ ID NO: 1628 - DNA, 464 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaacatggatggtataccaaaggagttaaggaactagtcgcggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgct

SEQ ID NO: 1629 - DNA, 472 bp, Artificial
  TaSBEIIa-B allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaaacggcgtgaagtgaacatgacaggggggaccgcagagaaacttgaatcttcagaaccgactcagggcatgactgatggtgtaaccaaaggagttaaggaactagtcgcgggggagaaaccgcgagttgtcccaaaaccaggagatgggcagaaaaatatacgagattgacccaacgctgaaagatttttcggagccatcttgactacccggttaatgcctacccgctaattttcgctcattttgaattaaggtcctttcatcatgcaaatttgggggaaccatcaaagagggcaaatgactaggggaccactattttcatacagttccccctcatggtctgagaatatgct

SEQ ID NO: 1630 - DNA, 467 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcaggggaacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1631 - DNA, 466 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcgaatcttcagaaccgactcagggcacaaatcactggatggtgtaaccaaaggagttaaggaactagtcgtggggggagaaaccgcgagttgtcccaaaaccaggagatggggcagaaaaatatacgagattgacccaacactgaaagattttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgct

SEQ ID NO: 1632 - DNA, 471 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaaccggtaatgcctacccgctgctttcgctcattttgaattaaggtcctttcatcatgcaaatttggggaacatcaaagagacaaagactagggaccaccattttcatacagatcccctcgtggtcctgagaatatgctggga

SEQ ID NO: 1633 - DNA, 426 bp, Artificial
  TaSBEIIa-D allele with mutations introduced by TALEN pair TaSBEIIa_T02
agatggatgtgcattctagcaagaacttcacaaaataatgcactgtttgtggtttcgtttgtctgctctacgattgctatttttcgtgctgtagatacctgaagatatcgaggagcaaacggcggaagtgaacatgacaggggggactgcagagaaacttcaatcttcagaaccgactcagggcattaaacaatcactgatggtgtaaccaaaggagttaaggaactagtcgtggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccacc

SEQ ID NO: 1634 - DNA, 409 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggacgtgcagagaaacttcaatcttcagaaccgactcagggcattgtagcgtgggtctcgcggtatcattgcagcactgggaaacaatcactgatggtgtaaccaaaggagttaaggaactagtcgtggggagaaaccgcgagttggatcccaaaaccatggagatcgggcaacgaaaaagtatacggagattgaacccaacgctgaaagattttcggagccatcttgactaccggtaatgccacccgctactttcgctcatttttg

SEQ ID NO: 1635 - DNA, 457 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattagacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaaccggtaatgcctacccgctgctttcgctcattttgaattaaggtcctttcatcatgcaaatttggggaacatcaaagagacaaagactagggaccaccattttcatacagatcccctcgtggtcc

SEQ ID NO: 1636 - DNA, 452 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1637 - DNA, 466 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggaacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1638 - DNA, 473 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattaaacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaaccggtaatgcctacccgctgctttcgctcattttgaattaaggtcctttcatcatgcaaatttggggaacatcaaagagacaaagactagggaccaccattttcatacagatcccctcgtggtcctgagaatatgctggga

SEQ ID NO: 1639 - DNA, 451 bp, Artificial
  TaSBEIIa-D allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagatatcgaggagcaaacggcggaagtgaacatgacagggggactgcagagaaacttcaatcttcagaaccgactcagggatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1640 - DNA, 462 bp, Artificial
  TaSBEIIa-D allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcaatcactgatggtgtaaccaaaggagttaaggaactagtcgcggggagaaaccgcgagttgtcccaaaaccaggagatgggcagaaaatatacgagattgacccaacactgaaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 1641 - DNA, 467 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcatcatgcaaattttggggaacatcaaagagacaaagactagggaccaccattttcatacagatcccctcgtggtctgagaatatgctggga

SEQ ID NO: 1642 - DNA, 455 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1643 - DNA, 536 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgcttaattctccgctcatgatcattggatctagatgcattcgcgaggtaccgagctcgaattcactggccgtcgaaacaatcactgatggtgtaaccaaaggagttaaggaactagtcgtggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgc

SEQ ID NO: 1644 - DNA, 457 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggatggtgtaaccaaaggagttaaggaactagtcgtgggggagaaaccgcgagttgtcccaaaaaccaggagatgggcagaaaatatacgagaatttgacccaacactgaaagatttttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 1645 - DNA, 451 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcaggagtggtacaaacaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1646 - DNA, 470 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1647 - DNA, 453 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaaatttggggaacatcaaagagacaaagactagggaccaccattttcatacagatcccctcgtggtctgagaatatgctggga

SEQ ID NO: 1648 - DNA, 456 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacgagggggactgcagagaaacttcaatcttcagaaccgactcagggcattgtaacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggt

SEQ ID NO: 1649 - DNA, 472 bp, Artificial
  TaSBEIIa-D allele with mutations introduced by TALEN pair TaSBEIIa_T02
  misc_feature (197): n is a or c or t or g
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcatcatgaacaacngaatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 1650 - DNA, 468 bp, Artificial
  TaSBEIIa-D allele with mutations introduced by TALEN pair TaSBEIIa_T02
agatggatgtgcattctagcaagaacttcacgaaataatgcactgtttgtggtttcgtcagtctgctctacaattgctatttttcgtgctgtagatacctgaagatatcgaggagcaaacggcggaagtgaacatgacagggggactgcagagaaacttcaatcttcagaaccgactcagggcatacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1651 - DNA, 468 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaaattaaggtcctttcatcatgcaaattttggggaacatcaaagagacaaagactagggaccaccattttcatacagatcccctcgtggtctgagaatatgctggga

SEQ ID NO: 1652 - DNA, 473 bp, Artificial
  TaSBEIIa-D allele with mutations introduced by TALEN pair TaSBEIIa_T02
  misc_feature (197): n is a or c or t or g
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggaatcatgaacaacngaatggtgtaaccaaaggagttaaggaactagtcgtgggggagaaaccgcgagttgtcccaaaaccaggagatggggcagaaaaatatacgagattgacccaacactgaaagattttcggagccatcttgactaaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 1653 - DNA, 470 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaaccggtaatgcctacccgctgctttcgctcattttgaattaaggtcctttcatcatgcaaatttggggaacatcaaagaggcaaagactagggaccactattttcattacaggttcccctcatggtctgagaatatgctggga

SEQ ID NO: 1654 - DNA, 463 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcgtcatgcaaatttggggaacatcaaagagacaaagactagggaccactattttcttacagttccccctcatggtctgagaatatgct

SEQ ID NO: 1655 - DNA, 455 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcaattttgaaattaaggtcctttcatcatgcaaaatttggggaacatcaaagagacaaagactagggaccaccattttcatacagatcccctcgtggtctg

SEQ ID NO: 1656 - DNA, 467 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggaacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcatcatgcaaattttggggaacatcaaagagacaaagactagggaccaccattttcatacagatcccctcgtggtctgagaatatgctggga

SEQ ID NO: 1657 - DNA, 464 bp, Artificial
  TaSBEIIa-D allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgatcactgatggtgtaaccaaaggagttaaggaactagtcgtggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 1658 - DNA, 503 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgttcggctacagccagcagcaacaggagaagatcaaaccgaaggttcgttcgaaaacaatcactgatggtgtaaccaaaggagttaaggaactagtcgtggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggt

SEQ ID NO: 1659 - DNA, 470 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaaccggtaatgcctacccgctactttcgctcattttgaattaaggtcctttcgtcatgcaaatttggggaacatcaaagagacaaagactagggaccactattttcttacagttcccctcatggtctgagaatatgctggga

SEQ ID NO: 1660 - DNA, 527 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgcttaattctccgctcatgatcattggatctagatgcattcgcgaggtaccgagctcgaattcactggccgtcgaaacaatcactgatggtgtaaccaaaggagttaaggaactagtcgtggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcgtcatgcaaatttggggaacatcaaagagacaaagactagggaccactatttcttacagttcccctcatggtctg

SEQ ID NO: 1661 - DNA, 517 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgcatacactattctcagaatgacttggttgagtactcaccagtcacagaaaagcatctacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgcttcgctcatttgaattaaggtcctttcatcatgcaaatttgggaacatcaaagagacaaagactagggaccaccatttcatacagatcccctcgtggtctgagaatatgct

SEQ ID NO: 1662 - DNA, 456 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 1663 - DNA, 460 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcatcatgcaaatttggggaacatcaaagaggcaaagactagggaccactattttcatacagttcccctcatggtctgagaatat

SEQ ID NO: 1664 - DNA, 463 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcaaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1665 - DNA, 472 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtaacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1666 - DNA, 473 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggacgtgcagagaaacttcaatcttcaagaaccgactcagggcaaacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaaattaaggtcctttcatcatgcaaattttgggggaaacatcaaagagacaaagactagggaccaccattttcatacagatcccctcgtggtctgagaatatgctggg

SEQ ID NO: 1667 - DNA, 455 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggctgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcacatgcaaatttggggaacatcaaagagacaaagactagggaccaccattttcatacagatcccctcgtggtctgagaatatgctggga

SEQ ID NO: 1668 - DNA, 467 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcgtcatgcaaatttggggaacatcaaagagacaaagactagggaccactattttcttacagttccccctcatggtccgagaatatgctggga

SEQ ID NO: 1669 - DNA, 466 bp, Artificial; identical to SEQ ID NO: 1637
  TaSBEIIa-D allele with mutations introduced by TALEN pair TaSBEIIa_T02

SEQ ID NO: 1670 - DNA, 438 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggaacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccactattttcttacagtt

SEQ ID NO: 1671 - DNA, 536 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgcttaattctccgctcatgatcattggatctagatgcattcgcgaggtaccgagctcgaattcactggccgtcgaaacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattcatacagatccctccgtggtctgagaatatgc

SEQ ID NO: 1672 - DNA, 466 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattaaacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaaccggttaagcctaccgctgctttcgctcattttgaaattaaggtcctttcgtcatgcaaatttggggaacatcaaagagacaaagactagggaccactattttcttacagttcccctcatggtctgagaatatg

SEQ ID NO: 1673 - DNA, 520 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgcatacactattctcagaatgacttggttgagtactcaccagtcacagaaaagcatctacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgct

SEQ ID NO: 1674 - DNA, 469 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcgaatcttcagaaccgactcagggcacaacactggatggtgtaaccaaaggagttaaggaactagtcgtggggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcatcatgcaaattttggggaacatcaaagagacaaagactagggaccaccattttcatacagatcccctcgtggtctgagaatatgctggga

SEQ ID NO: 1675 - DNA, 505 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtagcgtgggtctcgcggtatcattgcagcactgggaaacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaaatttggggaacatcaaagagacaaagactagggaccaccatttcatacagatcccctcgtggtctgagaatatgctggga

SEQ ID NO: 1676 - DNA, 461 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgttcggctacagccagcagcaacaggagaagatcaaaccgaaggttcgttcgaaaacaatcactgatggtgtaaccaaaggagttaaggaactagtcgtgggggagaaaccgcgagttgtcccaaaaccaggagatgggcagaaaaatatacgagattgacccaacactgaaagattttcggagccatcttgactaccggtaatgcctacccgctgctttcgctcattttgaattaaggtcctttcatcatgcaaatttggggaacatcaaaga

SEQ ID NO: 1677 - DNA, 457 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagtcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1678 - DNA, 536 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgcttaattctccgctcatgatcattggatctagatgcattcgcgaggtaccgagctcgaattcactggccgtcgaaacaatcactgatggtgtaaccaaaggagttaaggaactagtcgtggggagaaaccgcgagttgtcccaaaaccaggagatgggcagaaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgc

SEQ ID NO: 1679 - DNA, 474 bp, Artificial
  TaSBEIIa-D allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagatatcgaggagcaaacggcggaagtgaacatgacagggggactgcagagaaacttcaatcttcagaaccgactcagggcattgtaacaatcactgatggtgtaaccaaaggagttaaggaactagtcgtggggggagaaaccgcgagttgtcccaaaaccaggagatggggcagaaaaatatacgagattgacccaacactgaaagatttttcggagccatcttgactaccggtaatgcctacccgctgctttcgctcattttgaattaaggtcctttcatcatgcaaattttggggaacatcaaagagacaaagactagggaccaccattttcatacagatccccctcgtggtctgagaatatgctggga

SEQ ID NO: 1680 - DNA, 468 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaaccggtaatgcctacccgctgctttcgctcattttgaattaaggtcctttcatcatgcaaatttggggaacatcaaagaggcaaagactagggaccactattttcatacagttcccctcatggtctgagaatatgctggga

SEQ ID NO: 1681 - DNA, 467 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggaacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaaattaaggtcctttcatcatgcaaatttggggaacatcaaagagacaaagactagggaccaccattttcatacagatcccctcgtggtctgagaatatgctggga

SEQ ID NO: 1682 - DNA, 458 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagtcactgatggtgtaaccaaaggagttaaggaactagtcgtggggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1683 - DNA, 472 bp, Artificial; identical to SEQ ID NO: 1665
  TaSBEIIa-D allele with mutations introduced by TALEN pair TaSBEIIa_T02

SEQ ID NO: 1684 - DNA, 627 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgcgggactctaatcataaaaacccatctcataaataacgtcatgcattacatgttaattattacatgcttaacgtaatcagtgaggcacctatctcagcgatctgtctatttcgttcatccatatgttaattattacatgcttaacgtaattcaacagaaattataacaatcactgatggtgtaaccaaaggagttaaggaactagtcgtgggggagaaaccgcgagttgtccccaaaaccaggagatgggcagaaaaatatacgagattgacccaacactgaaagattttcggagccatcttgactaccggtaatgcctacccgctgcttcgctcattttgaattaaggtcctttcatcatgcaaatttgggaacatcaaagagacaaagactagggaccaccatttcatacagatccctcgtggtctgagaatatgct

SEQ ID NO: 1685 - DNA, 473 bp, Artificial
  TaSBEIIa-D allele with mutations introduced by TALEN pair TaSBEIIa_T02
  misc_feature (198): n is a or c or t or g
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcaatcatgaacaacngatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaaattaaggtcctttcatcatgcaaatttgggggaacatcaaagagacaaagactagggaccaccattttcatacagatcccctcgtggtctgagaatatgctggga

SEQ ID NO: 1686 - DNA, 466 bp, Artificial; identical to SEQ ID NO: 1637
  TaSBEIIa-D allele with mutations introduced by TALEN pair TaSBEIIa_T02

SEQ ID NO: 1687 - DNA, 506 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtagcgtgggtctcgcggtatcattgcagcactgggaaacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaaatttgggggaacatcaaagagacaaagactagggaccaccatttcatacagatcccctcgtggtctgagaatatgctggga

SEQ ID NO: 1688 - DNA, 460 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtaacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccactattttcatacagttcccctcatggtctgag

SEQ ID NO: 1689 - DNA, 444 bp, Artificial
  TaSBEIIa-D allele with mutations introduced by TALEN pair TaSBEIIa_T02
  misc_feature (290): n is a or c or t or g
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgcttaattctccgctcatgatcattggatctagatgcattcgcgaggtaccgagctcgaattcactggccgtcgaaacaatcactgatggtgtaaccaaaggngttaaggaactagtcgtggggagaaaccgcgagttgtcccaaaaaccaggagatgggcagaaaaatatacgagattgacccaaacactgaaagattttcggagccatcttgactacccggtaatgcctacccgctgctttcgctcatttttgaa

SEQ ID NO: 1690 - DNA, 466 bp, Artificial
  TaSBEIIa-D allele with mutations introduced by TALEN pair TaSBEIIa_T02
agatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatacaatcactgatggtgtaaccaaaggagttaaggaactagtcgcggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 1691 - DNA, 467 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaaattaaggtcctttcgtcatgcaaatttggggaacatcaaagagacaaagactagggaccactattttcttacagttcccctcatggtccgagaatatgctggga

SEQ ID NO: 1692 - DNA, 533 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgcttaattctccgctcatgatcattggatctagatgcattcgcgaggtaccgagctcgaattcactggccgtcgaaacaatcactgatggtgtaaccaaaggagttaaggaactagtcgtggggagaaaccgcgagttgtcccaaaaccaggagatgggcagaaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaat

SEQ ID NO: 1693 - DNA, 538 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgcttaattctccgctcatgatcattggatctagatgcattcgcgaggtaccgagctcgaattcactggccgtcgaaacaatcactgatggtgtaaccaaaggagttaaggaactagtcgtgggggagaaaccgcgagttgtcccaaaaccaggagatgggcagaaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgc

SEQ ID NO: 1694 - DNA, 626 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgcgggactctaatcataaaaacccatctcataaataacgtcatgcattacatgttaattattacatgcttaacgtaatcagtgaggcacctatctcagcgatctgtctatttcgttcatccatatgttaattattacatgcttaacgtaattcaacagaaattataacaatcactgatggtgtaaccaaaggagttaaggaactagtcgtgggggagaaaccgcgagttgtcccaaaaccaggagatgggcagaaaatatacgagattgacccaacactgaaagatttttcggagccatcttgactaccggtaatgcctacccgctgcttcgctcattttgaattaaggtcctttcatcatgcaatttgggaacatcaagagacaaagactagggaccaccaattttcatacagatccctcgtggtctgagaatatgct

SEQ ID NO: 1695 - DNA, 457 bp, Artificial; identical to SEQ ID NO: 1677
  TaSBEIIa-D allele with mutations introduced by TALEN pair TaSBEIIa_T02

SEQ ID NO: 1696 - DNA, 445 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcgtcatgcaaatttggggaacatcaaagagacaaagactagggaccactattttcttacagttccccctc

SEQ ID NO: 1697 - DNA, 472 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaaccggtaatgcctacccgctgctttcgctcattttgaattaaggtcctttcatcatgcaaatttggggaacatcaaagagacaaagactagggaccaccattttcatacagatccccatcgtggtcctgagaatatgctggga

SEQ ID NO: 1698 - DNA, 457 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctattttcgtgctgtagatacctgaagatatcgaggagcaaacggcggaagtgaacatgacagggggactgcagagaaacttcaatcttcagaaccgactcagggcattgttcggctacagccagcagcaacaggagaagatcaaaccgaaggttcgttcgaaaacaatcactgatggtgtaaccaaaggagttaaggaactagtcgtggggagaaaccgcgagttgtcccaaaaccaggagatgggcagaaaaatatacgagattgacccaacactgaaagatttcggagccatcttgactaccggtaaatgcctacccgctgcttcgctcattttgaattaaggtcctttcatcatgcaaatttggggaaccatcaaa

SEQ ID NO: 1699 - DNA, 452 bp, Artificial; identical to SEQ ID NO: 1636
  TaSBEIIa-D allele with mutations introduced by TALEN pair TaSBEIIa_T02

SEQ ID NO: 1700 - DNA, 447 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaaattaaggtcctttcgtcatgcaaatttgggggaacatcaaagagacaaagactagggaccactattttcttacagttccccctc

SEQ ID NO: 1701 - DNA, 469 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1702 - DNA, 529 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgcttaattctccgctcatgatcattggatctagatgcattcgcgaggtaccgagctcgaattcactggccgtcgaaacaatcactgatggtgtaaccaaaggagttaaggaactagtcgtggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgag

SEQ ID NO: 1703 - DNA, 459 bp, Artificial
  TaSBEIIa-D allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagatatcgaggagcaaacggcggaagtgaacatgacagggggactgcagagaaacttcaatcttcagaaccgactcagggcattgtaacaatcactgatggtgtaaccaaaggagttaaggaactagtcgtggggggagaaaccgcgagttgtcccaaaaccaggagatggggcagaaaaatatacgagattgacccaacactgaaagatttttcggagccatcttgactaccggtaatgcctacccgctgctttcgctcaattttgaaattaaggtcctttcatcatgcaaatttggggaacatcaaagagacaaagactagggaccaccattttcatacagatcccctcgtggtcc

SEQ ID NO: 1704 - DNA, 476 bp, Artificial
  TaSBEIIa-D allele with mutations introduced by TALEN pair TaSBEIIa_T02
agatggatgtgcattctagcaagaacttcacgaaataatgcactgtttgtggtttcgttagtctgctctacaattgctattttcgtgctgtagatacctgaagatatcgaggagcaaacggcggaagtgaacatgacaggggggactgcagagaaacttcaatcttcagaaccgactcaggggcattgtaacaatcactgatggtgtaaccaaaggagttaaggaactagtcgtggggggagaaaccgcgagttgtcccaaaaccaggagatggggcagaaaaatatacgagattgacccaacactgaaagattttcggagccatcttgactaccggtaatgcctacccgctgctttcgctcattttgaaattaaggtcctttcatcatgcaaatttgggggaacatcaaagagacaaagactaggggaccaccattttcatacagatcccctcgtggtctgagaatatgctggga

SEQ ID NO: 1705 - DNA, 466 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattaaacaatcactgatggtgtaaccaaaggagttaaggaactagtcgtgggggagaaaccgcgagttgtcccaaaaccaggagatggggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 1706 - DNA, 468 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaaattaaggtcctttcatcatgcaaatttggggaaacatcaaagagacaaagactagggaccaccattttcatacagatcccctcgtggtctgagaatatgctggga

SEQ ID NO: 1707 - DNA, 456 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggctgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1708 - DNA, 468 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattgatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcatcatgcaaatttggggaacatcaaagaggcaaagctagggaccactattttcaatacaggttcccctcatggtctgagaatatgctggga

SEQ ID NO: 1709 - DNA, 478 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggacgtgcagagaaacttcaatcttcaagaaccgactcagggcaacaatcactggatggtgtaaccaaaggagttaaggaactagtcgtggggggagaaaccgcgagttgtcccaaaaccaggagatggggcagaaaaatatacgagattgacccaacactgaaagattttcggagccatcttgactaccggtaatgcctacccgctgcttttcgctcattttgaaattaaggtcctttcatcatgcaaaattttgggggaaacatcaaagagacaaagactaggggaccaccattttcatacagatcccctcgtggtctgagaatatgctggga

SEQ ID NO: 1710 - DNA, 470 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacagggggactgcagagaaacttcaatcttcagaaccgactcagggcattacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtcctgagaatatgctggga

SEQ ID NO: 1711 - DNA, 472 bp, Artificial
  TaSBEIIa-D allele with mutations introduced by TALEN pair TaSBEIIa_T02
agatggatgtgcattctagcaagaacttcacaacataatgcaccgtttgggggtttcgtcagtctgctctacaattgctatttttcgtgctgtagatacctgaagatatcgaggagcaaacggcggaagtgaacatgacaggggggactgcagagaaacttcaatcttcagaaccgactcagggcattaaacaatcactgatggtgtaaccaaaggagttaaggaactagtcgtgggggagaaaccgcgagttgtcccaaaaccaggagatggggcagaaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 1712 - DNA, 391 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgatcttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgcc

SEQ ID NO: 1713 - DNA, 440 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 1714 - DNA, 392 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgcc

SEQ ID NO: 1715 - DNA, 399 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccgtcctggtgcctgacggtgagagcgacgacttggcaagtccggcgcaacctgaagaattacaggtacacaccatcgtgccggaaatcttcatacaatcgttattcacttaccaaatgccggatgaaaccaagccgcggaggcgtcaggttttgagcttcttctatcagcattgtgcagtactgcactgccttgtgcattttg

SEQ ID NO: 1716 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgctggctcttgggccactgaa

SEQ ID NO: 1717 - DNA, 442 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgctggctcttgggccactgaa

SEQ ID NO: 1718 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacgggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgcctgtgcatttttgttagccgtggcccgctgctggctcttgggccactgaa

SEQ ID NO: 1719 - DNA, 441 bp, Artificial; identical to SEQ ID NO: 1716
  TaSBEIIa-A allele with mutations introduced by TALEN pair TaSBEIIa_T03

SEQ ID NO: 1720 - DNA, 429 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttggg

SEQ ID NO: 1721 - DNA, 440 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggcccgctgctggctcttgggccactgaa

SEQ ID NO: 1722 - DNA, 443 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgctggctcttgggccactgaa

SEQ ID NO: 1723 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacgggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggcccgctgctggctcttgggccactgaa

SEQ ID NO: 1724 - DNA, 494 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtagcggtggtttttttgtttgcaagcagcagtattacgcgcagaaaaaaggaaggtcctggtgcctgaacggtggagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 1725 - DNA, 426 bp, Artificial
  TaSBEIIa-A allele with mutations introduced by TALEN pair TaSBEIIa_T03
gagatagctggattaggcgatcgcctgcgtcagtgtcacccaggccctggtcgttgatgtccaacgggccttttggatcatctcctcccattctgatattttctcactctttcttctgttcttgctgtaactgcaagttgtagcattgtctcactattgtagtcatccttgcattgcaggcgccgtcctgagccgcgcggcctctccagggatgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtgg

SEQ ID NO: 1726 - DNA, 441 bp, Artificial; identical to SEQ ID NO: 1716
  TaSBEIIa-A allele with mutations introduced by TALEN pair TaSBEIIa_T03

SEQ ID NO: 1727 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgatcttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 1728 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgcctgtgcatttttgttagccgtggcccgcgtgctggctcttgggccactgaa

SEQ ID NO: 1729 - DNA, 441 bp, Artificial; identical to SEQ ID NO: 1716
  TaSBEIIa-A allele with mutations introduced by TALEN pair TaSBEIIa_T03

SEQ ID NO: 1730 - DNA, 440 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 1731 - DNA, 442 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgctggctcttgggccactgaa

SEQ ID NO: 1732 - DNA, 443 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggatgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 1733 - DNA, 425 bp, Artificial
  TaSBEIIa-A allele with mutations introduced by TALEN pair TaSBEIIa_T03
gagatagctggattaggcgatcgcctgcgtcagtgtcacccaggccctggtcgttatgtcacggctttgatcatctcctcccattctgatatttctcactctttcttctgttcttgctgtaactgcaagttgtagcattgtctcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggaatgcgttcaggtttcgagcttcttctatcagcattgtgcagtactgcactgccttgttcattttgttagccttggccccgtgc

SEQ ID NO: 1734 - DNA, 440 bp, Artificial; identical to SEQ ID NO: 1713
  TaSBEIIa-A allele with mutations introduced by TALEN pair TaSBEIIa_T03

SEQ ID NO: 1735 - DNA, 475 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggatcgcccatgactagcaggtaagggcgaaaactcacgttaagggattttggtcatgagattatcaaaagtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttag

SEQ ID NO: 1736 - DNA, 445 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaagggatgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgctggctcttgggccactgaa

SEQ ID NO: 1737 - DNA, 414 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtgg

SEQ ID NO: 1738 - DNA, 416 bp, Artificial
  TaSBEIIa-A allele with mutations introduced by TALEN pair TaSBEIIa_T03
  misc_feature (297): n is a or c or t or g
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaaggtcctggtgccctgacggtgagagcgacgacttggcaagtccggcgcaacctgaagaattacaggtacacaccatcgtgccgggaaatcttcgatncaatcgtattcacttaccaaatgccggatgaaaccaagccgcggaggcgtcaggttttgagcttcttctatcagcattgtgcagtactgcactgccttgtgcatttttgttagccgtgg

SEQ ID NO: 1739 - DNA, 442 bp, Artificial; identical to SEQ ID NO: 1717
  TaSBEIIa-A allele with mutations introduced by TALEN pair TaSBEIIa_T03

SEQ ID NO: 1740 - DNA, 373 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagccgcgcggcctctcgagagcgacgacttggcaagtccggcgcaacctgaagaattacaggtacacaccatcgtgccgggaaaatcttcaatacaatcgttattcacttaccaaatgccggatgaaaccaagccgcggaggcgtcaggttttgagcttcttctatcagcattgtgcagtactgcactgccttg

SEQ ID NO: 1741 - DNA, 443 bp, Artificial; identical to SEQ ID NO: 1722
  TaSBEIIa-A allele with mutations introduced by TALEN pair TaSBEIIa_T03

SEQ ID NO: 1742 - DNA, 399 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgcttgtgcatttg

SEQ ID NO: 1743 - DNA, 444 bp, Artificial
  TaSBEIIa-A allele with mutations introduced by TALEN pair TaSBEIIa_T03
gagatagctggattaggcgatcgcctgcgtcagtgtcacccaggccctggtcgttgattcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgctggctcttgggccactgaa

SEQ ID NO: 1744 - DNA, 425 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggc

SEQ ID NO: 1745 - DNA, 478 bp, Artificial
  TaSBEIIa-A allele with mutations introduced by TALEN pair TaSBEIIa_T03
  misc_feature (440): n is a or c or t or g
gagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagccgcgcggcctctccagtgtacccctccagcgtgaccgagttcaagttcctgttcgtgtccggccacttcaagggcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagnactgcactgccttgtgcattttgttagccgtggccccg

SEQ ID NO: 1746 - DNA, 493 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtagcggtggttttttgtttgcaagcagcagtattacgcgcagaaaaaaggaaggtcctggtgcctgaacggtggagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 1747 - DNA, 419 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccg

SEQ ID NO: 1748 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 1749 - DNA, 513 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatacaatcgttattcacttacccaaaatgccggatgaaacccaaagccgcggaggcgtcaggttttgagcttcttctaatcagcattgtgcagtactgcacttgccttgtgcattttgttagccgtggcccgtgctggctcttgggccactg

SEQ ID NO: 1750 - DNA, 456 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacttggtctgacagttaccaatgcttaatcagtgaggcacctatctcagcgaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttag

SEQ ID NO: 1751 - DNA, 440 bp, Artificial; identical to SEQ ID NO: 1713
  TaSBEIIa-A allele with mutations introduced by TALEN pair TaSBEIIa_T03

SEQ ID NO: 1752 - DNA, 440 bp, Artificial; identical to SEQ ID NO: 1713
  TaSBEIIa-A allele with mutations introduced by TALEN pair TaSBEIIa_T03

SEQ ID NO: 1753 - DNA, 439 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 1754 - DNA, 442 bp, Artificial; identical to SEQ ID NO: 1731
  TaSBEIIa-A allele with mutations introduced by TALEN pair TaSBEIIa_T03

SEQ ID NO: 1755 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgtagccgtggccccgctgctggctcttgggccactgaa

SEQ ID NO: 1756 - DNA, 442 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagatgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgctggctcttgggccactgaa

SEQ ID NO: 1757 - DNA, 423 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgtagccgtggccccgtgctggctc

SEQ ID NO: 1758 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 1759 - DNA, 505 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggatcgcccatgactagcaggtaagggcgaaaactcacgttaagggattttggtcatgagattatcaaaagtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccact

SEQ ID NO: 1760 - DNA, 440 bp, Artificial; identical to SEQ ID NO: 1713
  TaSBEIIa-A allele with mutations introduced by TALEN pair TaSBEIIa_T03

SEQ ID NO: 1761 - DNA, 425 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgct

SEQ ID NO: 1762 - DNA, 397 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccg

SEQ ID NO: 1763 - DNA, 440 bp, Artificial; identical to SEQ ID NO: 1713
  TaSBEIIa-A allele with mutations introduced by TALEN pair TaSBEIIa_T03

SEQ ID NO: 1764 - DNA, 440 bp, Artificial; identical to SEQ ID NO: 1713
  TaSBEIIa-A allele with mutations introduced by TALEN pair TaSBEIIa_T03

SEQ ID NO: 1765 - DNA, 449 bp, Artificial
  TaSBEIIa-A allele with mutations introduced by TALEN pair TaSBEIIa_T03
gagatagctggattaggcgatcgcctgcgtcagtgtcacccaggccctggtcgttgatgtccaacgggcttttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggcccgctgctggctcttgggccactgaa

SEQ ID NO: 1766 - DNA, 446 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccgaagggatgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgctggctcttgggccactgaa

SEQ ID NO: 1767 - DNA, 405 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttg

SEQ ID NO: 1768 - DNA, 439 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgtagccgtggcccgctgctggctcttgggccactg

SEQ ID NO: 1769 - DNA, 493 bp, Artificial
  TaSBEIIa-A allele with mutations introduced by TALEN pair TaSBEIIa_T03
  misc_feature (441): n is a or c or t or g
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagtgtacccctccagcgtgaccgagttcaagttcctgttcgtgtccggccacttcaagggcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagnactgcactgccttgtgcattttgttagccgtggccccgtgctggctcttggg

SEQ ID NO: 1770 - DNA, 406 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctc

SEQ ID NO: 1771 - DNA, 443 bp, Artificial
  TaSBEIIa-A allele with mutations introduced by TALEN pair TaSBEIIa_T03
gagatagctggattaggcgatcgcctgcgtcagtgtcacccaggccctggtcgttattcacgggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccgctgctggctcttgggccactgaa

SEQ ID NO: 1772 - DNA, 476 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggatcgccccatgactagcaggtaagggcgaaaactcacgttaagggattttggtcatgagattatcaaaagtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttag

SEQ ID NO: 1773 - DNA, 440 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgctggctcttgggccactgaa

SEQ ID NO: 1774 - DNA, 481 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaagtcacgttatgaccccgccgctgactgacggagcaagccgttttacgtttggaactgaggtgagagcgacgacttggcaagtccggcgcacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 1775 - DNA, 442 bp, Artificial; identical to SEQ ID NO: 1717
  TaSBEIIa-A allele with mutations introduced by TALEN pair TaSBEIIa_T03

SEQ ID NO: 1776 - DNA, 367 bp, Artificial
  TaSBEIIa-A allele with mutations introduced by TALEN pair TaSBEIIa_T03
gagatagctggattaggcgatcgcctgcgtcagtgtcacccaggccctggtcgttattcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatac

SEQ ID NO: 1777 - DNA, 460 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggatcgcccatgactagcaggtaagggcgaaaactcacgttaagggattttggtcatgagattatcaaaagtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgcct

SEQ ID NO: 1778 - DNA, 467 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggatcgccccatgactagcaggtaagggcgaaaactcacgttaagggattttggtcatgagattatcaaaagtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgca

SEQ ID NO: 1779 - DNA, 440 bp, Artificial; identical to SEQ ID NO: 1713
  TaSBEIIa-A allele with mutations introduced by TALEN pair TaSBEIIa_T03

SEQ ID NO: 1780 - DNA, 395 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcatgtactgcactgccttg

SEQ ID NO: 1781 - DNA, 424 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctc

SEQ ID NO: 1782 - DNA, 429 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctc

SEQ ID NO: 1783 - DNA, 410 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttggg

SEQ ID NO: 1784 - DNA, 560 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaaagccgcgggaggcgtcaggtttttgagcttcttctatcagcattgtgcagtactgcactgccttgtgcatttttgtttaagccgtggccccgtgctggct

SEQ ID NO: 1785 - DNA, 440 bp, Artificial; identical to SEQ ID NO: 1713
  TaSBEIIa-A allele with mutations introduced by TALEN pair TaSBEIIa_T03

SEQ ID NO: 1786 - DNA, 416 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactg

SEQ ID NO: 1787 - DNA, 455 bp, Artificial
  TaSBEIIa-A allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgctggctcttgggccactg

SEQ ID NO: 1788 - DNA, 421 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggatgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccg

SEQ ID NO: 1789 - DNA, 427 bp, Artificial
  TaSBEIIa-A allele with mutations introduced by TALEN pair TaSBEIIa_T03
  misc_feature (416): n is a or c or t or g
gagatagctggattaggcgatcgcgcttcctgaacctgtattttttccccgcgggaagatgcgttagtgtcacccaggccctggtgttaccacggctttgatcatctccttccattctgatatttcttcactctttcttctgttcttgctgtaactgcaagttgtagcatgttctcactattgtagtcatccttgcatttgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagnactgcactgcc

SEQ ID NO: 1790 - DNA, 440 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 1791 - DNA, 441 bp, Artificial; identical to SEQ ID NO: 1758
  TaSBEIIa-A allele with mutations introduced by TALEN pair TaSBEIIa_T03

SEQ ID NO: 1792 - DNA, 416 bp, Artificial; identical to SEQ ID NO: 1786
  TaSBEIIa-A allele with mutations introduced by TALEN pair TaSBEIIa_T03

SEQ ID NO: 1793 - DNA, 490 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggatcgcccatgactagcaggtaaggggcgaaaactcacgttaagggattttggtcatgagattatcaaaagtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgc

SEQ ID NO: 1794 - DNA, 441 bp, Artificial; identical to SEQ ID NO: 1758
  TaSBEIIa-A allele with mutations introduced by TALEN pair TaSBEIIa_T03

SEQ ID NO: 1795 - DNA, 442 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 1796 - DNA, 447 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaagtcacgttatgaccaccgccgatgacgcgggacaagccgttttacgtttggaactgaggtgagagcgacgacttggcaagtccggcgcacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttag

SEQ ID NO: 1797 - DNA, 448 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacttggtctgacagttaccaatgcttaatcagtgaggcacctatctcagcgaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgca

SEQ ID NO: 1798 - DNA, 506 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggcccgtgctggctcttgggccactg

SEQ ID NO: 1799 - DNA, 392 bp, Artificial
  TaSBEIIa-A allele with mutations introduced by TALEN pair TaSBEIIa_T03
gagatagctggattaggcgatcgcctgcgtcagtgtcacccaggccctggtgttatcacgggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgcc

SEQ ID NO: 1800 - DNA, 440 bp, Artificial; identical to SEQ ID NO: 1713
  TaSBEIIa-A allele with mutations introduced by TALEN pair TaSBEIIa_T03

SEQ ID NO: 1801 - DNA, 446 bp, Artificial; identical to SEQ ID NO: 1766
  TaSBEIIa-A allele with mutations introduced by TALEN pair TaSBEIIa_T03

SEQ ID NO: 1802 - DNA, 446 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacttggtctgacagttaccaatgcttaatcagtgaggcacctatctcagcgaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctattcagcattgtgcagtactgcactgccttgt

SEQ ID NO: 1803 - DNA, 441 bp, Artificial; identical to SEQ ID NO: 1748
  TaSBEIIa-A allele with mutations introduced by TALEN pair TaSBEIIa_T03

SEQ ID NO: 1804 - DNA, 469 bp, Artificial
  TaSBEIIa-A allele with mutations introduced by TALEN pair TaSBEIIa_T03
  misc_feature (377): n is a or c or t or g
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatacaatcgttattcncttaccaaaatgccggatgaaaccaagccgcggaggcgtcaggttttgagcttcttctatcagcattgtgcagtactgcactgccttgtgca

SEQ ID NO: 1805 - DNA, 442 bp, Artificial; identical to SEQ ID NO: 1795
  TaSBEIIa-A allele with mutations introduced by TALEN pair TaSBEIIa_T03

SEQ ID NO: 1806 - DNA, 413 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggc

SEQ ID NO: 1807 - DNA, 442 bp, Artificial; identical to SEQ ID NO: 1795
  TaSBEIIa-A allele with mutations introduced by TALEN pair TaSBEIIa_T03

SEQ ID NO: 1808 - DNA, 441 bp, Artificial; identical to SEQ ID NO: 1758
  TaSBEIIa-A allele with mutations introduced by TALEN pair TaSBEIIa_T03

SEQ ID NO: 1809 - DNA, 440 bp, Artificial; identical to SEQ ID NO: 1713
  TaSBEIIa-A allele with mutations introduced by TALEN pair TaSBEIIa_T03

SEQ ID NO: 1810 - DNA, 441 bp, Artificial; identical to SEQ ID NO: 1758
  TaSBEIIa-A allele with mutations introduced by TALEN pair TaSBEIIa_T03

SEQ ID NO: 1811 - DNA, 442 bp, Artificial; identical to SEQ ID NO: 1795
  TaSBEIIa-A allele with mutations introduced by TALEN pair TaSBEIIa_T03

SEQ ID NO: 1812 - DNA, 441 bp, Artificial; identical to SEQ ID NO: 1758
  TaSBEIIa-A allele with mutations introduced by TALEN pair TaSBEIIa_T03

SEQ ID NO: 1813 - DNA, 438 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 1814 - DNA, 417 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactg

SEQ ID NO: 1815 - DNA, 480 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaagtcacgttatgaccccgccgcatgacgcggagcaagccgttttacgtttggaactgaggtgagagcgacgacttggcaagtccggcgcacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 1816 - DNA, 440 bp, Artificial; identical to SEQ ID NO: 1713
  TaSBEIIa-A allele with mutations introduced by TALEN pair TaSBEIIa_T03

SEQ ID NO: 1817 - DNA, 555 bp, Artificial
  TaSBEIIa-A allele with mutations introduced by TALEN pair TaSBEIIa_T03
  misc_feature (291): n is a or c or t or g
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacgccacctctgacttgagcgtcgatttttgtgatgctcgtcagggggcggagcctatgaaaaacgccagcaacgcggcctttttacggttccnggcccttttgctggccttttgctaaggtcctggtgcctgacggtgagagcgacgacttggcaagtccggcgcaacctgaagaattacaggtacacaccatcgtgccgggaaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactg

SEQ ID NO: 1818 - DNA, 444 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggatgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgctggctcttgggccactgaa

SEQ ID NO: 1819 - DNA, 431 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaagggatgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctc

SEQ ID NO: 1820 - DNA, 441 bp, Artificial; identical to SEQ ID NO: 1716
  TaSBEIIa-A allele with mutations introduced by TALEN pair TaSBEIIa_T03

SEQ ID NO: 1821 - DNA, 441 bp, Artificial; identical to SEQ ID NO: 1758
  TaSBEIIa-A allele with mutations introduced by TALEN pair TaSBEIIa_T03

SEQ ID NO: 1822 - DNA, 443 bp, Artificial; identical to SEQ ID NO: 1722
  TaSBEIIa-A allele with mutations introduced by TALEN pair TaSBEIIa_T03

SEQ ID NO: 1823 - DNA, 442 bp, Artificial; identical to SEQ ID NO: 1795
  TaSBEIIa-A allele with mutations introduced by TALEN pair TaSBEIIa_T03

SEQ ID NO: 1824 - DNA, 442 bp, Artificial; identical to SEQ ID NO: 1795
  TaSBEIIa-A allele with mutations introduced by TALEN pair TaSBEIIa_T03

SEQ ID NO: 1825 - DNA, 441 bp, Artificial; identical to SEQ ID NO: 1716
  TaSBEIIa-A allele with mutations introduced by TALEN pair TaSBEIIa_T03

SEQ ID NO: 1826 - DNA, 443 bp, Artificial; identical to SEQ ID NO: 1732
  TaSBEIIa-A allele with mutations introduced by TALEN pair TaSBEIIa_T03

SEQ ID NO: 1827 - DNA, 533 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttttgagcttcttctatcagcattgtgcagtactgcactgccttgtgcatttttg

SEQ ID NO: 1828 - DNA, 457 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacttggtctgacagttaccaatgcttaatcagtgaggcacctatctcagcgaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttag

SEQ ID NO: 1829 - DNA, 440 bp, Artificial; identical to SEQ ID NO: 1713
  TaSBEIIa-A allele with mutations introduced by TALEN pair TaSBEIIa_T03

SEQ ID NO: 1830 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggcccgctgctggctcttgggccactgaa

SEQ ID NO: 1831 - DNA, 440 bp, Artificial; identical to SEQ ID NO: 1713
  TaSBEIIa-A allele with mutations introduced by TALEN pair TaSBEIIa_T03

SEQ ID NO: 1832 - DNA, 442 bp, Artificial; identical to SEQ ID NO: 1795
  TaSBEIIa-A allele with mutations introduced by TALEN pair TaSBEIIa_T03

SEQ ID NO: 1833 - DNA, 446 bp, Artificial
  TaSBEIIa-A allele with mutations introduced by TALEN pair TaSBEIIa_T03
gagatagctggattaggcgatcgcctgcgtcagtgtcacccaggccctggtcgttattcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggatgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgctggctcttgggccactgaa

SEQ ID NO: 1834 - DNA, 441 bp, Artificial; identical to SEQ ID NO: 1716
  TaSBEIIa-A allele with mutations introduced by TALEN pair TaSBEIIa_T03

SEQ ID NO: 1835 - DNA, 467 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgca

SEQ ID NO: 1836 - DNA, 439 bp, Artificial; identical to SEQ ID NO: 1753
  TaSBEIIa-A allele with mutations introduced by TALEN pair TaSBEIIa_T03

SEQ ID NO: 1837 - DNA, 528 bp, Artificial
  TaSBEIIa-A allele with mutations introduced by TALEN pair TaSBEIIa_T03
  misc_feature (390): n is a or c or t or g
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacnggtacacaccatcgtgccgggaaatcttcatacaatcgttattcacttaccaaatgccggatgaaaccaagccgcggaggcgtcaggtttttgagcttcttctatcagcattgtgcaggttactgcactgccttgtgc

SEQ ID NO: 1838 - DNA, 442 bp, Artificial; identical to SEQ ID NO: 1795
  TaSBEIIa-A allele with mutations introduced by TALEN pair TaSBEIIa_T03

SEQ ID NO: 1839 - DNA, 508 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactg

SEQ ID NO: 1840 - DNA, 440 bp, Artificial; identical to SEQ ID NO: 1713
  TaSBEIIa-A allele with mutations introduced by TALEN pair TaSBEIIa_T03

SEQ ID NO: 1841 - DNA, 403 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgagagcgacgacttggcaagtccggcgcaacctgaagaattacaggtacacaccatcgtgccgggaaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctgg

SEQ ID NO: 1842 - DNA, 440 bp, Artificial; identical to SEQ ID NO: 1773
  TaSBEIIa-A allele with mutations introduced by TALEN pair TaSBEIIa_T03

SEQ ID NO: 1843 - DNA, 375 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatatttctcactctttcttctgttcttgctgtaactgcaagttgtagcattgtctcactattgtagtcatccttgcattgcaggcgccgtcctgagccgcgcggcctctcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgca

SEQ ID NO: 1844 - DNA, 416 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccact

SEQ ID NO: 1845 - DNA, 441 bp, Artificial; identical to SEQ ID NO: 1748
  TaSBEIIa-A allele with mutations introduced by TALEN pair TaSBEIIa_T03

SEQ ID NO: 1846 - DNA, 441 bp, Artificial; identical to SEQ ID NO: 1748
  TaSBEIIa-A allele with mutations introduced by TALEN pair TaSBEIIa_T03

SEQ ID NO: 1847 - DNA, 451 bp, Artificial
  TaSBEIIa-A allele with mutations introduced by TALEN pair TaSBEIIa_T03
gagatagctggattaggcgatcgcctgcgtcagtgtcacccaggccctggtcgttgatgtccaacgggccttttggatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggcccgctgctggctcttgggccactgaa

SEQ ID NO: 1848 - DNA, 441 bp, Artificial; identical to SEQ ID NO: 1758
  TaSBEIIa-A allele with mutations introduced by TALEN pair TaSBEIIa_T03

SEQ ID NO: 1849 - DNA, 427 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctc

SEQ ID NO: 1850 - DNA, 441 bp, Artificial; identical to SEQ ID NO: 1748
  TaSBEIIa-A allele with mutations introduced by TALEN pair TaSBEIIa_T03

SEQ ID NO: 1851 - DNA, 481 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaagtcacgttatgacccccgccgatgacgcgggagcaagccgttttacgtttggaactgaggtgagagcgacgacttggcaagtccggcgcacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 1852 - DNA, 443 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggatgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 1853 - DNA, 439 bp, Artificial; identical to SEQ ID NO: 1753
  TaSBEIIa-A allele with mutations introduced by TALEN pair TaSBEIIa_T03

SEQ ID NO: 1854 - DNA, 441 bp, Artificial; identical to SEQ ID NO: 1758
  TaSBEIIa-A allele with mutations introduced by TALEN pair TaSBEIIa_T03

SEQ ID NO: 1855 - DNA, 554 bp, Artificial
  TaSBEIIa-A allele with mutations introduced by TALEN pair TaSBEIIa_T03
  misc_feature (291): n is a or c or t or g
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacgccacctctgacttgagcgtcgatttttgtgatgctcgtcagggggcggagcctatgaaaaacgccagcaacgcggcctttttacggttccnggcccttttgctggccttttgctaaggtcctggtgcctgacggtgagagcgacgacttggcaagtccggcgcaacctgaagaattacaggtacacaccatcgtgccgggaaaatcttcatacaatcgttattcacttaccaaatgccggatgaaaccaagccgcggaggcgtcaggttttgagcttcttctatcagcattgtgcagtactgcactgccttgtgcatttgttagccgtggcccgtgctggctcttgggccactg

SEQ ID NO: 1856 - DNA, 415 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgagagcgacgacttggcaagtccggcgcacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccact

SEQ ID NO: 1857 - DNA, 419 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccg

SEQ ID NO: 1858 - DNA, 473 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattttgcaggcgccgtcctgagccgcgcggcctctccaggaaagaacatgtgagcaaaaggccagcaaaaggccaggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcctt

SEQ ID NO: 1859 - DNA, 441 bp, Artificial; identical to SEQ ID NO: 1716
  TaSBEIIa-A allele with mutations introduced by TALEN pair TaSBEIIa_T03

SEQ ID NO: 1860 - DNA, 441 bp, Artificial; identical to SEQ ID NO: 1716
  TaSBEIIa-A allele with mutations introduced by TALEN pair TaSBEIIa_T03

SEQ ID NO: 1861 - DNA, 440 bp, Artificial; identical to SEQ ID NO: 1713
  TaSBEIIa-A allele with mutations introduced by TALEN pair TaSBEIIa_T03

SEQ ID NO: 1862 - DNA, 494 bp, Artificial; identical to SEQ ID NO: 1724
  TaSBEIIa-A allele with mutations introduced by TALEN pair TaSBEIIa_T03

SEQ ID NO: 1863 - DNA, 498 bp, Artificial
  TaSBEIIa-A allele with mutations introduced by TALEN pair TaSBEIIa_T03
gagatagctggattaggcgatcgcctgcgtcagtgtcacccaggccctggtcgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaatatttcttgtcaaaaatgctccactgaccgtctccagcgcctgcttgccgccatcgtggctgggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaaagccgcggaggcgtcaggttttgagcttcttctatcagcattgtgcagtactgcactgccttgtgcattttgttagccgtggcccgctgctggctctt

SEQ ID NO: 1864 - DNA, 439 bp, Artificial; identical to SEQ ID NO: 1753
  TaSBEIIa-A allele with mutations introduced by TALEN pair TaSBEIIa_T03

SEQ ID NO: 1865 - DNA, 457 bp, Artificial; identical to SEQ ID NO: 1828
  TaSBEIIa-A allele with mutations introduced by TALEN pair TaSBEIIa_T03

SEQ ID NO: 1866 - DNA, 458 bp, Artificial
  TaSBEIIa-A allele with mutations introduced by TALEN pair TaSBEIIa_T03
  misc_feature (440): n is a or c or t or g
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagtgtacccctccagcgtgaccgagttcaagttcctgttcgtgtccggccacttcaagggcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgacttcttctatcagcattgtgcagnactgcactgccttgtgca

SEQ ID NO: 1867 - DNA, 399 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctccccattctgatattttctcactctttctttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgc

SEQ ID NO: 1868 - DNA, 418 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgagagcgacgacttggcaagtccggcgcaacctgaagaatttacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactg

SEQ ID NO: 1869 - DNA, 441 bp, Artificial; identical to SEQ ID NO: 1716
  TaSBEIIa-A allele with mutations introduced by TALEN pair TaSBEIIa_T03

SEQ ID NO: 1870 - DNA, 493 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtagcggtggtttttttgtttgcaagcagcagattacgcgcagaaaaaaggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 1871 - DNA, 462 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttctttctgttcttgctgtaactgcaagttgtagcattgtctcactattgtagtcatccttgcattgcaggcgccgtcctgagccgcgcggcctctccaagtcacgttatgaccccgccgatgaccgcgggacaagccgttttacgtttggaactgaggtgagagcgacgacttggcaagtccggcgcacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgc

SEQ ID NO: 1872 - DNA, 505 bp, Artificial; identical to SEQ ID NO: 1759
  TaSBEIIa-A allele with mutations introduced by TALEN pair TaSBEIIa_T03

SEQ ID NO: 1873 - DNA, 441 bp, Artificial; identical to SEQ ID NO: 1758
  TaSBEIIa-A allele with mutations introduced by TALEN pair TaSBEIIa_T03

SEQ ID NO: 1874 - DNA, 502 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactcttttcttcctgttcttgctgtaactgcaagttgtgctgtttcactattgtagtcatccttgcatttgcaggcgccgtcctgagccgcgcggcctctccagggtttttttgtttgcaagcagcagattatcgcgcagaaaaaacaggaaggcaaaatgccgcaaaaagggaggtcctgtgctgacgcgagaagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcca

SEQ ID NO: 1875 - DNA, 440 bp, Artificial; identical to SEQ ID NO: 1713
  TaSBEIIa-A allele with mutations introduced by TALEN pair TaSBEIIa_T03

SEQ ID NO: 1876 - DNA, 558 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacgccacctctgacttgagcgtcgatttttgtgatgctcgtcagggggcggagcctatgaaaaacgccagcaacgcggcctttttacggttcctggccctttttgctgggcctttttgctaaggtcctggtgcctgacggtgagagcgacgacttggcaagtccggcgcaacctgaagaattacaggtacacaccatcgtgccgggaaaatcttcatacaatcgttattcacttaccaaatgccggatgaaaccaagccgcggaggcgtcaggttttgagcttcttctatcagcattgtgcagtactgcactgccttgtgcattttgttagccgtggcccgtgctggctcttgggccactg

SEQ ID NO: 1877 - DNA, 442 bp, Artificial; identical to SEQ ID NO: 1795
  TaSBEIIa-A allele with mutations introduced by TALEN pair TaSBEIIa_T03

SEQ ID NO: 1878 - DNA, 478 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaagtcacgttatgaccccgccgcatgactgacgggaggacaagccgttttacgtttggaactgaggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttggg

SEQ ID NO: 1879 - DNA, 557 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacgccacctctgacttgagcgtcgattttttgtgatgctcgtcagggggcggagcctatggaaaaacgccagcaacgcggccttttttacggttcctggcccttttgctggccttttgctaaggtcctggtgcctgacggtgagagcgacgacttggcaagtccggcgcaacctgaagaattacaggtacacaccatcgtgccgggaaaatcttcatacaatcgttattcacttaccaaatgccggatgaaaccaagccgcggaggcgtcaggttttgagcttcttctatcagcattgtgcagtactgcactgccttgtgcatttgttagccgtggcccgtgctggctcttgggccactg

SEQ ID NO: 1880 - DNA, 468 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgca

SEQ ID NO: 1881 - DNA, 440 bp, Artificial; identical to SEQ ID NO: 1713
  TaSBEIIa-A allele with mutations introduced by TALEN pair TaSBEIIa_T03

SEQ ID NO: 1882 - DNA, 440 bp, Artificial
  TaSBEIIa-A allele with mutations introduced by TALEN pair TaSBEIIa_T03
gagatagctggattaggcgatcgcctgcgtcagtgtcacccagaccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 1883 - DNA, 440 bp, Artificial; identical to SEQ ID NO: 1713
  TaSBEIIa-A allele with mutations introduced by TALEN pair TaSBEIIa_T03

SEQ ID NO: 1884 - DNA, 516 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacgccacctctgacttgagcgtcgatttttgtgatgctcgtcagggggcggagcctatgaaaaacgccagcaacgcggcctttttacggttcctggcccttttgctggccttttgctaaggtcctggtgcctgacggtgagagcgacgacttggcaagtccggcgcaacctgaagaattacaggtacacaccatcgtgccgggaaaatcttcatacaatcgttattcacttaccaaatgccggatgaaaccaagccgcggaggcgtcaggttttgagcttcttctatcagcattgtgcagtactgcactgccttgtgca

SEQ ID NO: 1885 - DNA, 441 bp, Artificial; identical to SEQ ID NO: 1748
  TaSBEIIa-A allele with mutations introduced by TALEN pair TaSBEIIa_T03

SEQ ID NO: 1886 - DNA, 473 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggggaatttatggaacgtcagtggagcatttttcccctcggtatccaattagagtctcatattcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttag

SEQ ID NO: 1887 - DNA, 440 bp, Artificial; identical to SEQ ID NO: 1713
  TaSBEIIa-A allele with mutations introduced by TALEN pair TaSBEIIa_T03

SEQ ID NO: 1888 - DNA, 439 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgttcattttgttagccttggccccgtgctggctcttgggccactgaa

SEQ ID NO: 1889 - DNA, 416 bp, Artificial; identical to SEQ ID NO: 1786
  TaSBEIIa-A allele with mutations introduced by TALEN pair TaSBEIIa_T03

SEQ ID NO: 1890 - DNA, 416 bp, Artificial; identical to SEQ ID NO: 1844
  TaSBEIIa-A allele with mutations introduced by TALEN pair TaSBEIIa_T03

SEQ ID NO: 1891 - DNA, 490 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacttggtctgacagttaccaatgcttaatcagtgaggcacctatctcagcgaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 1892 - DNA, 440 bp, Artificial; identical to SEQ ID NO: 1713
  TaSBEIIa-A allele with mutations introduced by TALEN pair TaSBEIIa_T03

SEQ ID NO: 1893 - DNA, 494 bp, Artificial; identical to SEQ ID NO: 1724
  TaSBEIIa-A allele with mutations introduced by TALEN pair TaSBEIIa_T03

SEQ ID NO: 1894 - DNA, 419 bp, Artificial; identical to SEQ ID NO: 1747
  TaSBEIIa-A allele with mutations introduced by TALEN pair TaSBEIIa_T03

SEQ ID NO: 1895 - DNA, 441 bp, Artificial; identical to SEQ ID NO: 1758
  TaSBEIIa-A allele with mutations introduced by TALEN pair TaSBEIIa_T03

SEQ ID NO: 1896 - DNA, 494 bp, Artificial; identical to SEQ ID NO: 1724
  TaSBEIIa-A allele with mutations introduced by TALEN pair TaSBEIIa_T03

SEQ ID NO: 1897 - DNA, 440 bp, Artificial; identical to SEQ ID NO: 1713
  TaSBEIIa-A allele with mutations introduced by TALEN pair TaSBEIIa_T03

SEQ ID NO: 1898 - DNA, 440 bp, Artificial; identical to SEQ ID NO: 1713
  TaSBEIIa-A allele with mutations introduced by TALEN pair TaSBEIIa_T03

SEQ ID NO: 1899 - DNA, 501 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagtgtacccctccagcgtgaccgagttcaagttcctgttcgtgtccggccacttcaagggcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcatcaggtttcaagcttcttctatcagcattgtgcactacttcactgccttgtgcagtttgttagctgtggccccgcgctggctcttgggccactgaa

SEQ ID NO: 1900 - DNA, 440 bp, Artificial; identical to SEQ ID NO: 1713
  TaSBEIIa-A allele with mutations introduced by TALEN pair TaSBEIIa_T03

SEQ ID NO: 1901 - DNA, 441 bp, Artificial; identical to SEQ ID NO: 1748
  TaSBEIIa-A allele with mutations introduced by TALEN pair TaSBEIIa_T03

SEQ ID NO: 1902 - DNA, 507 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactg

SEQ ID NO: 1903 - DNA, 440 bp, Artificial; identical to SEQ ID NO: 1713
  TaSBEIIa-A allele with mutations introduced by TALEN pair TaSBEIIa_T03

SEQ ID NO: 1904 - DNA, 498 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgagcttcttctatcagcattgtgcagtactgcactgccttgtgcattttgttagccgtggccccgtgctggctctt

SEQ ID NO: 1905 - DNA, 429 bp, Artificial; identical to SEQ ID NO: 1782
  TaSBEIIa-A allele with mutations introduced by TALEN pair TaSBEIIa_T03

SEQ ID NO: 1906 - DNA, 501 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagtgtacccctccagcgtgaccgagttcaagttcctgttcgtgtccggccacttcaagggcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 1907 - DNA, 476 bp, Artificial; identical to SEQ ID NO: 1772
  TaSBEIIa-A allele with mutations introduced by TALEN pair TaSBEIIa_T03

SEQ ID NO: 1908 - DNA, 417 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccg

SEQ ID NO: 1909 - DNA, 441 bp, Artificial; identical to SEQ ID NO: 1748
  TaSBEIIa-A allele with mutations introduced by TALEN pair TaSBEIIa_T03

SEQ ID NO: 1910 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgcagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 1911 - DNA, 558 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttttgagcttcttctatcagcattgtgcagttactgcactgccttgtgcattttgtttagccgtggccccgtgctggctc

SEQ ID NO: 1912 - DNA, 413 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgtatttttgttagccgtgg

SEQ ID NO: 1913 - DNA, 441 bp, Artificial; identical to SEQ ID NO: 1748
  TaSBEIIa-A allele with mutations introduced by TALEN pair TaSBEIIa_T03

SEQ ID NO: 1914 - DNA, 441 bp, Artificial; identical to SEQ ID NO: 1748
  TaSBEIIa-A allele with mutations introduced by TALEN pair TaSBEIIa_T03

SEQ ID NO: 1915 - DNA, 457 bp, Artificial; identical to SEQ ID NO: 1828
  TaSBEIIa-A allele with mutations introduced by TALEN pair TaSBEIIa_T03

SEQ ID NO: 1916 - DNA, 421 bp, Artificial; identical to SEQ ID NO: 1788
  TaSBEIIa-A allele with mutations introduced by TALEN pair TaSBEIIa_T03

SEQ ID NO: 1917 - DNA, 496 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtagcggtggtttttttgtttgcaagcagcagtattacgcgcagaaaaaaaggaaggtcctggtgcctgaacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 1918 - DNA, 475 bp, Artificial; identical to SEQ ID NO: 1735
  TaSBEIIa-A allele with mutations introduced by TALEN pair TaSBEIIa_T03

SEQ ID NO: 1919 - DNA, 471 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacttggtctgacagttaccaatgcttaatcagtgaggcacctatctcagcgaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgc

SEQ ID NO: 1920 - DNA, 429 bp, Artificial; identical to SEQ ID NO: 1782
  TaSBEIIa-A allele with mutations introduced by TALEN pair TaSBEIIa_T03

SEQ ID NO: 1921 - DNA, 440 bp, Artificial; identical to SEQ ID NO: 1713
  TaSBEIIa-A allele with mutations introduced by TALEN pair TaSBEIIa_T03

SEQ ID NO: 1922 - DNA, 440 bp, Artificial; identical to SEQ ID NO: 1713
  TaSBEIIa-A allele with mutations introduced by TALEN pair TaSBEIIa_T03

SEQ ID NO: 1923 - DNA, 444 bp, Artificial
  TaSBEIIa-A allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcgtgcctgacggtgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 1924 - DNA, 442 bp, Artificial; identical to SEQ ID NO: 1795
  TaSBEIIa-A allele with mutations introduced by TALEN pair TaSBEIIa_T03

SEQ ID NO: 1925 - DNA, 442 bp, Artificial; identical to SEQ ID NO: 1795
  TaSBEIIa-A allele with mutations introduced by TALEN pair TaSBEIIa_T03

SEQ ID NO: 1926 - DNA, 441 bp, Artificial; identical to SEQ ID NO: 1758
  TaSBEIIa-A allele with mutations introduced by TALEN pair TaSBEIIa_T03

SEQ ID NO: 1927 - DNA, 442 bp, Artificial; identical to SEQ ID NO: 1717
  TaSBEIIa-A allele with mutations introduced by TALEN pair TaSBEIIa_T03

SEQ ID NO: 1928 - DNA, 441 bp, Artificial; identical to SEQ ID NO: 1758
  TaSBEIIa-A allele with mutations introduced by TALEN pair TaSBEIIa_T03

SEQ ID NO: 1929 - DNA, 410 bp, Artificial; identical to SEQ ID NO: 1783
  TaSBEIIa-A allele with mutations introduced by TALEN pair TaSBEIIa_T03

SEQ ID NO: 1930 - DNA, 441 bp, Artificial; identical to SEQ ID NO: 1758
  TaSBEIIa-A allele with mutations introduced by TALEN pair TaSBEIIa_T03

SEQ ID NO: 1931 - DNA, 445 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctccccattctgatattttctcactctttcttctgttcttgctgtaactgcaagttgtagcattgtctcactattgtagtcatccttgcattgcaggcgccgtcctgagccgcgcggcctctccaagggatgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 1932 - DNA, 441 bp, Artificial; identical to SEQ ID NO: 1758
  TaSBEIIa-A allele with mutations introduced by TALEN pair TaSBEIIa_T03

SEQ ID NO: 1933 - DNA, 442 bp, Artificial; identical to SEQ ID NO: 1795
  TaSBEIIa-A allele with mutations introduced by TALEN pair TaSBEIIa_T03

SEQ ID NO: 1934 - DNA, 440 bp, Artificial; identical to SEQ ID NO: 1713
  TaSBEIIa-A allele with mutations introduced by TALEN pair TaSBEIIa_T03

SEQ ID NO: 1935 - DNA, 458 bp, Artificial
  TaSBEIIa-A allele with mutations introduced by TALEN pair TaSBEIIa_T03
gagatagctggattaggcgatcgcctgcgtcagtgtcacccaggccctggtcgttatcacggctttgatcatctcctcccattctgatatttctcactctttcttctgttcttgctgtaactgcaagttgtagcattgtctcactattgtagtcatccttgcattgcaggcgccgtcctgagccgcgcggcctctccacttggtctgacagttaccaatgcttaatcagtgaggcacctatctcagcgaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctattcagcattgtgcagtactgcactgccttgtgcattttgttag

SEQ ID NO: 1936 - DNA, 502 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccaggggttttcccagtcacgacgttgtaaaacgacggccagtgaattcgagctcggtacctcgcgaatgcatctagatccaaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttttgagcttcttctatcagca

SEQ ID NO: 1937 - DNA, 424 bp, Artificial
  TaSBEIIa-A allele with mutations introduced by TALEN pair TaSBEIIa_T03
gagatagctggattaggcgatcgcctgcgtcagtgtcacccaggccctggtcgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgct

SEQ ID NO: 1938 - DNA, 441 bp, Artificial; identical to SEQ ID NO: 1758
  TaSBEIIa-A allele with mutations introduced by TALEN pair TaSBEIIa_T03

SEQ ID NO: 1939 - DNA, 441 bp, Artificial; identical to SEQ ID NO: 1748
  TaSBEIIa-A allele with mutations introduced by TALEN pair TaSBEIIa_T03

SEQ ID NO: 1940 - DNA, 501 bp, Artificial; identical to SEQ ID NO: 1906
  TaSBEIIa-A allele with mutations introduced by TALEN pair TaSBEIIa_T03

SEQ ID NO: 1941 - DNA, 501 bp, Artificial; identical to SEQ ID NO: 1906
  TaSBEIIa-A allele with mutations introduced by TALEN pair TaSBEIIa_T03

SEQ ID NO: 1942 - DNA, 476 bp, Artificial; identical to SEQ ID NO: 1772
  TaSBEIIa-A allele with mutations introduced by TALEN pair TaSBEIIa_T03

SEQ ID NO: 1943 - DNA, 416 bp, Artificial; identical to SEQ ID NO: 1786
  TaSBEIIa-A allele with mutations introduced by TALEN pair TaSBEIIa_T03

SEQ ID NO: 1944 - DNA, 493 bp, Artificial; identical to SEQ ID NO: 1870
  TaSBEIIa-A allele with mutations introduced by TALEN pair TaSBEIIa_T03

SEQ ID NO: 1945 - DNA, 528 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacacccatcgtgccgggaaatcttcatacaatcgttattcacttaccaaatgccggatgaaaccaagccgcgggaggcgtcaggtttttgagcttcttctatcagcatgtgcagtactgcactgccttgtgca

SEQ ID NO: 1946 - DNA, 430 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttggg

SEQ ID NO: 1947 - DNA, 441 bp, Artificial; identical to SEQ ID NO: 1758
  TaSBEIIa-A allele with mutations introduced by TALEN pair TaSBEIIa_T03

SEQ ID NO: 1948 - DNA, 439 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 1949 - DNA, 440 bp, Artificial; identical to SEQ ID NO: 1713
  TaSBEIIa-A allele with mutations introduced by TALEN pair TaSBEIIa_T03

SEQ ID NO: 1950 - DNA, 482 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaagtcacgttatgacccccgccgcatgacgcgggagcaagccgttttacgtttggaactgaggtgagagcgacgacttggcaagtccggcgcacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 1951 - DNA, 528 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttttgagcttcttctatcagcattgtgcagttactgcactgccttgtgca

SEQ ID NO: 1952 - DNA, 416 bp, Artificial; identical to SEQ ID NO: 1786
  TaSBEIIa-A allele with mutations introduced by TALEN pair TaSBEIIa_T03

SEQ ID NO: 1953 - DNA, 485 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccggggaaatcttcatacaatcgttattcacttaccaaaatgccggatgaaaccaagccgcggaggcgtcaggttttgagcttcttctatcagcattgtgcagtactgcactgccttgtgcattttgttagccgtgg

SEQ ID NO: 1954 - DNA, 441 bp, Artificial; identical to SEQ ID NO: 1748
  TaSBEIIa-A allele with mutations introduced by TALEN pair TaSBEIIa_T03

SEQ ID NO: 1955 - DNA, 440 bp, Artificial; identical to SEQ ID NO: 1713
  TaSBEIIa-A allele with mutations introduced by TALEN pair TaSBEIIa_T03

SEQ ID NO: 1956 - DNA, 443 bp, Artificial; identical to SEQ ID NO: 1732
  TaSBEIIa-A allele with mutations introduced by TALEN pair TaSBEIIa_T03

SEQ ID NO: 1957 - DNA, 495 bp, Artificial
  TaSBEIIa-A allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattgtctcactattgtagtcatccttgcattgcaggcgccgtcctgagccgcgcggcctctccaggatcgcccatgactagcaggtaagggcgaaaactcacgttaagggattttggtcatgagattatcaaaagtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttttgagcttcttctatcagcattgtgcagtactgcactgccttgtgcattttgttagccgtggccccgtgctggctcttgggccact

SEQ ID NO: 1958 - DNA, 439 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 1959 - DNA, 422 bp, Artificial
  TaSBEIIa-A allele with mutations introduced by TALEN pair TaSBEIIa_T03
  misc_feature (67); (392): n is a or c or t or g
gagatagctggattaggcgatcgcctgcgtcagtgtcacccaggccctggtgttatcacggctttgntacatctcctccccattctgatattttctcactctttcttctgttcttgctgtaactgcaagttgtagcattgtctcactattgtagtcatccttgcattgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactnccttgtgcatttttgttagccgtggccccg

SEQ ID NO: 1960 - DNA, 440 bp, Artificial; identical to SEQ ID NO: 1713
  TaSBEIIa-A allele with mutations introduced by TALEN pair TaSBEIIa_T03

SEQ ID NO: 1961 - DNA, 439 bp, Artificial; identical to SEQ ID NO: 1753
  TaSBEIIa-A allele with mutations introduced by TALEN pair TaSBEIIa_T03

SEQ ID NO: 1962 - DNA, 440 bp, Artificial; identical to SEQ ID NO: 1713
  TaSBEIIa-A allele with mutations introduced by TALEN pair TaSBEIIa_T03

SEQ ID NO: 1963 - DNA, 502 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctccccattctgatattttctcactctttcttctgttcttgctgtaactgcaagttgtagcattgtctcactattgtagtcatccttgcattgcaggcgccgtcctgagccgcgcggcctctccagtgtacccctccagcgtgaccgagttcaagttcctgttcgtgtccggccacttcaagggcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 1964 - DNA, 473 bp, Artificial; identical to SEQ ID NO: 1886
  TaSBEIIa-A allele with mutations introduced by TALEN pair TaSBEIIa_T03

SEQ ID NO: 1965 - DNA, 440 bp, Artificial; identical to SEQ ID NO: 1713
  TaSBEIIa-A allele with mutations introduced by TALEN pair TaSBEIIa_T03

SEQ ID NO: 1966 - DNA, 438 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactg

SEQ ID NO: 1967 - DNA, 491 bp, Artificial
  TaSBEIIa-A allele with mutations introduced by TALEN pair TaSBEIIa_T03
  misc_feature (442): n is a or c or t or g
gagatagctggattaggcgatcgcctgcgtcagtgtcacccaggccctggtgttatcacggctttgatcatctcctccccattctgatattttctcactctttcttctgttcttgctgtaactgcaagttgtagcattgtctcactattgtagtcatccttgcattgcaggcgccgtcctgagccgcgcggcctctccagtgtacccctccagcgtgaccgagttcaagttcctgttcgtgtccggccacttcaagggcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagnactgcactgccttgtgcattttgttagccgtggccccgtgctggctctt

SEQ ID NO: 1968 - DNA, 458 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacttggtctgacagttaccaatgcttaatcagtgaggcacctatctcagcgaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttag

SEQ ID NO: 1969 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggcccctgctggctcttgggccactgaa

SEQ ID NO: 1970 - DNA, 442 bp, Artificial; identical to SEQ ID NO: 1795
  TaSBEIIa-A allele with mutations introduced by TALEN pair TaSBEIIa_T03

SEQ ID NO: 1971 - DNA, 483 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtgg

SEQ ID NO: 1972 - DNA, 441 bp, Artificial; identical to SEQ ID NO: 1758
  TaSBEIIa-A allele with mutations introduced by TALEN pair TaSBEIIa_T03

SEQ ID NO: 1973 - DNA, 426 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctctt

SEQ ID NO: 1974 - DNA, 423 bp, Artificial
  TaSBEIIa-A allele with mutations introduced by TALEN pair TaSBEIIa_T03
gagatagctggattaggcgatcgcctgcgtcagtgtcacccaggccctggtcgttatcacgggctttgatcatctcctcccattctgatattttctcactctttcttctgttcttgctgtaactgcaagttgtagcattgtctcactattgtagtcatccttgcattgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgc

SEQ ID NO: 1975 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatccatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 1976 - DNA, 441 bp, Artificial; identical to SEQ ID NO: 1758
  TaSBEIIa-A allele with mutations introduced by TALEN pair TaSBEIIa_T03

SEQ ID NO: 1977 - DNA, 492 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtagcggtggtttttttgtttgcaagcagcagattacgcgcagaaaaaaggaaggtcctggtgcctgacggtgagagcgacgacttggcaagtccggcgcacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 1978 - DNA, 440 bp, Artificial; identical to SEQ ID NO: 1713
  TaSBEIIa-A allele with mutations introduced by TALEN pair TaSBEIIa_T03

SEQ ID NO: 1979 - DNA, 470 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaagtcacgttatgaccccgccgcatgacgcgggagcaagccgttttacgtttggaactgaggtgagagcgacgacttggcaagtccggcgcacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctctt

SEQ ID NO: 1980 - DNA, 444 bp, Artificial
  TaSBEIIa-A allele with mutations introduced by TALEN pair TaSBEIIa_T03
gagatagctggattaggcgatcgcctgcgtcagtgtcaccccaggcccctggtgttatcacggctttgatcatctcctcccattctgatattttctcacttctttcttctgtcttgctgtaactgcaagttgtagcattgtctcactattgtagtcatccttgcattgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 1981 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgcctgtgcatttttgttagccgtggcccgctgctggctcttgggccactgaa

SEQ ID NO: 1982 - DNA, 475 bp, Artificial; identical to SEQ ID NO: 1735
  TaSBEIIa-A allele with mutations introduced by TALEN pair TaSBEIIa_T03

SEQ ID NO: 1983 - DNA, 439 bp, Artificial; identical to SEQ ID NO: 1753
  TaSBEIIa-A allele with mutations introduced by TALEN pair TaSBEIIa_T03

SEQ ID NO: 1984 - DNA, 440 bp, Artificial; identical to SEQ ID NO: 1713
  TaSBEIIa-A allele with mutations introduced by TALEN pair TaSBEIIa_T03

SEQ ID NO: 1985 - DNA, 441 bp, Artificial; identical to SEQ ID NO: 1758
  TaSBEIIa-A allele with mutations introduced by TALEN pair TaSBEIIa_T03

SEQ ID NO: 1986 - DNA, 440 bp, Artificial; identical to SEQ ID NO: 1713
  TaSBEIIa-A allele with mutations introduced by TALEN pair TaSBEIIa_T03

SEQ ID NO: 1987 - DNA, 422 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgct

SEQ ID NO: 1988 - DNA, 508 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttttgagcttcttctatcagcattgtgcag

SEQ ID NO: 1989 - DNA, 484 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatacaatcgttattcacttaccaaaatgccggatgaaaccaagccgcggaggcgtcaggttttgagcttcttctatcagcattgtgcagtactgcactgccttgtgcattttgttagccgtgg

SEQ ID NO: 1990 - DNA, 442 bp, Artificial; identical to SEQ ID NO: 1795
  TaSBEIIa-A allele with mutations introduced by TALEN pair TaSBEIIa_T03

SEQ ID NO: 1991 - DNA, 494 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtagcggtggttttttttgtttgcaagcagcagattacgcgcagaaaaaaggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 1992 - DNA, 392 bp, Artificial; identical to SEQ ID NO: 1714
  TaSBEIIa-A allele with mutations introduced by TALEN pair TaSBEIIa_T03

SEQ ID NO: 1993 - DNA, 442 bp, Artificial; identical to SEQ ID NO: 1795
  TaSBEIIa-A allele with mutations introduced by TALEN pair TaSBEIIa_T03

SEQ ID NO: 1994 - DNA, 543 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacgccacctctgacttgagcgtcgattttttgtgatgctcgtcagggggcggagcctatggaaaaacgccagcaacgcggccttttttacggttcctggccctttttgctggcctttttgctaaggtcctggtgcctgacggtgagagcgacgacttggcaagtccggcgcaacctgaagaattacaggtacacaccatcgtgccgggaaaatcttcatacaatcgttattcacttaccaaatgccggatgaaaccaagccgcggaggcgtcaggttttgagcttcttctatcagcattgtgcagtactgcactgccttgtgcattttgttagccgtggcccgtgc

SEQ ID NO: 1995 - DNA, 483 bp, Artificial; identical to SEQ ID NO: 1971
  TaSBEIIa-A allele with mutations introduced by TALEN pair TaSBEIIa_T03

SEQ ID NO: 1996 - DNA, 416 bp, Artificial; identical to SEQ ID NO: 1786
  TaSBEIIa-A allele with mutations introduced by TALEN pair TaSBEIIa_T03

SEQ ID NO: 1997 - DNA, 507 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttttgagcttcttctatcagcattgtgca

SEQ ID NO: 1998 - DNA, 440 bp, Artificial; identical to SEQ ID NO: 1713
  TaSBEIIa-A allele with mutations introduced by TALEN pair TaSBEIIa_T03

SEQ ID NO: 1999 - DNA, 490 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagtgtacccctccagcgtgaccgagttcaagttcctgttcgtgtccggccacttcaagggcaaggtcctggtgcccgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctctt

SEQ ID NO: 2000 - DNA, 430 bp, Artificial; identical to SEQ ID NO: 1946
  TaSBEIIa-A allele with mutations introduced by TALEN pair TaSBEIIa_T03

SEQ ID NO: 2001 - DNA, 440 bp, Artificial; identical to SEQ ID NO: 1882
  TaSBEIIa-A allele with mutations introduced by TALEN pair TaSBEIIa_T03

SEQ ID NO: 2002 - DNA, 441 bp, Artificial; identical to SEQ ID NO: 1748
  TaSBEIIa-A allele with mutations introduced by TALEN pair TaSBEIIa_T03

SEQ ID NO: 2003 - DNA, 444 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaagggatgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 2004 - DNA, 493 bp, Artificial; identical to SEQ ID NO: 1870
  TaSBEIIa-A allele with mutations introduced by TALEN pair TaSBEIIa_T03

SEQ ID NO: 2005 - DNA, 492 bp, Artificial; identical to SEQ ID NO: 1977
  TaSBEIIa-A allele with mutations introduced by TALEN pair TaSBEIIa_T03

SEQ ID NO: 2006 - DNA, 481 bp, Artificial
  TaSBEIIa-A allele with mutations introduced by TALEN pair TaSBEIIa_T03
  misc_feature (451): n is a or c or t or g
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttgacttcttctatcagcattgtgcagtacngcactgccttgtgcattttgttagccgtgg

SEQ ID NO: 2007 - DNA, 440 bp, Artificial; identical to SEQ ID NO: 1721
  TaSBEIIa-A allele with mutations introduced by TALEN pair TaSBEIIa_T03

SEQ ID NO: 2008 - DNA, 429 bp, Artificial; identical to SEQ ID NO: 1782
  TaSBEIIa-A allele with mutations introduced by TALEN pair TaSBEIIa_T03

SEQ ID NO: 2009 - DNA, 493 bp, Artificial; identical to SEQ ID NO: 1870
  TaSBEIIa-A allele with mutations introduced by TALEN pair TaSBEIIa_T03

SEQ ID NO: 2010 - DNA, 534 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaaacgccaggggttttccccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacacccatcgtgccgggaaatcttcatacaatcgttattcacttaccaaatgccggatgaaaccaagccgcggaggcgtcagttttgagcttcttctatcagcattgtgcagtactgcactgccttgtgcattttg

SEQ ID NO: 2011 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctccccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 2012 - DNA, 441 bp, Artificial; identical to SEQ ID NO: 1748
  TaSBEIIa-A allele with mutations introduced by TALEN pair TaSBEIIa_T03

SEQ ID NO: 2013 - DNA, 429 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaaccaagccgcggaggcgtcaggttttgagcttcttctatcagcattgtgcagtactgcactgccttgtgcatttttgttagccgtggccccgtgctggct

SEQ ID NO: 2014 - DNA, 477 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctccccattctgatattttctcactctttcttctgttcttgctgtaactgcaagttgtagcattgtctcactattgtagtcatccttgcattgcaggcgccgtcctgagccgcgcggcctctccaggtagcggtggtttttttgttgcaagcagcagtattacgcgcagaaaaaaggaaggtcctggtgcctgaacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaaggttttgagcttcttctatcagcattgtgcagtactgcactgccttgtgcattttgttagccgtggccccgtgc

SEQ ID NO: 2015 - DNA, 396 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacgccacctctgacttgagcgtcgatttttgtgatgctcgtcagggggcggagcctatgaaaaacgccagcaacgcggcctttttacggttcctggcccttttgctggcctttttgctaaggtccttggtgcctgacggtgagagcgacgacttggcaagtccggcgcaacctgagattacaggtacacaccagtcagt

SEQ ID NO: 2016 - DNA, 482 bp, Artificial; identical to SEQ ID NO: 1950
  TaSBEIIa-A allele with mutations introduced by TALEN pair TaSBEIIa_T03

SEQ ID NO: 2017 - DNA, 501 bp, Artificial
  TaSBEIIa-A allele with mutations introduced by TALEN pair TaSBEIIa_T03
  misc_feature (441): n is a or c or t or g
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagtgtacccctccagcgtgaccgagttcaagttcctgttcgtgtccggccacttcaagggcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagnactgcactgccttgtgcattttgttagccgtggccccgtgctggctcttgggccactgaa

SEQ ID NO: 2018 - DNA, 443 bp, Artificial; identical to SEQ ID NO: 1732
  TaSBEIIa-A allele with mutations introduced by TALEN pair TaSBEIIa_T03

SEQ ID NO: 2019 - DNA, 507 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggatcgccccatgactagcaggtaaggggcgaaaactcacgttaagggattttggtcatgagattatcaaaagtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccact

SEQ ID NO: 2020 - DNA, 480 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaagtcacgttatgaccccgccgatgacgcgggagcaagccgttttacgtttggaactgaggtgagagcgacgacttggcaagtccggcgcacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 2021 - DNA, 457 bp, Artificial; identical to SEQ ID NO: 1828
  TaSBEIIa-A allele with mutations introduced by TALEN pair TaSBEIIa_T03

SEQ ID NO: 2022 - DNA, 423 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcgacctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgct

SEQ ID NO: 2023 - DNA, 440 bp, Artificial; identical to SEQ ID NO: 1713
  TaSBEIIa-A allele with mutations introduced by TALEN pair TaSBEIIa_T03

SEQ ID NO: 2024 - DNA, 439 bp, Artificial; identical to SEQ ID NO: 1753
  TaSBEIIa-A allele with mutations introduced by TALEN pair TaSBEIIa_T03

SEQ ID NO: 2025 - DNA, 440 bp, Artificial; identical to SEQ ID NO: 1713
  TaSBEIIa-A allele with mutations introduced by TALEN pair TaSBEIIa_T03

SEQ ID NO: 2026 - DNA, 439 bp, Artificial; identical to SEQ ID NO: 1753
  TaSBEIIa-A allele with mutations introduced by TALEN pair TaSBEIIa_T03

SEQ ID NO: 2027 - DNA, 457 bp, Artificial; identical to SEQ ID NO: 1828
  TaSBEIIa-A allele with mutations introduced by TALEN pair TaSBEIIa_T03

SEQ ID NO: 2028 - DNA, 439 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgctggctcttgggccactg

SEQ ID NO: 2029 - DNA, 439 bp, Artificial; identical to SEQ ID NO: 1753
  TaSBEIIa-A allele with mutations introduced by TALEN pair TaSBEIIa_T03

SEQ ID NO: 2030 - DNA, 491 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctccccattctgatattttctcactctttcttctgttcttgctgtaactgcaagttgtagcattgtctcactattgtagtcatccttgcattgcaggcgccgtcctgagccgcgcggcctctccaggatcgccccatgactagcaggtaagggcgaaaactcacgttaagggattttggtcatgagattatcaaaagtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgc

SEQ ID NO: 2031 - DNA, 440 bp, Artificial; identical to SEQ ID NO: 1882
  TaSBEIIa-A allele with mutations introduced by TALEN pair TaSBEIIa_T03

SEQ ID NO: 2032 - DNA, 480 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaagtcacgttatgacccccgccgatgacgcgggacaagccgttttacgtttggaactgaggtgagagcgacgacttggcaagtccggcgcacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 2033 - DNA, 527 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttttgagcttcttctatcagcattgtgcagtactgcactgccttgtgca

SEQ ID NO: 2034 - DNA, 441 bp, Artificial; identical to SEQ ID NO: 1758
  TaSBEIIa-A allele with mutations introduced by TALEN pair TaSBEIIa_T03

SEQ ID NO: 2035 - DNA, 442 bp, Artificial; identical to SEQ ID NO: 1795
  TaSBEIIa-A allele with mutations introduced by TALEN pair TaSBEIIa_T03

SEQ ID NO: 2036 - DNA, 442 bp, Artificial; identical to SEQ ID NO: 1795
  TaSBEIIa-A allele with mutations introduced by TALEN pair TaSBEIIa_T03

SEQ ID NO: 2037 - DNA, 508 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcgggaggcgtcaggtttttgagcttcttctatcagcattgtgca

SEQ ID NO: 2038 - DNA, 493 bp, Artificial; identical to SEQ ID NO: 1870
  TaSBEIIa-A allele with mutations introduced by TALEN pair TaSBEIIa_T03

SEQ ID NO: 2039 - DNA, 480 bp, Artificial; identical to SEQ ID NO: 2032
  TaSBEIIa-A allele with mutations introduced by TALEN pair TaSBEIIa_T03

SEQ ID NO: 2040 - DNA, 442 bp, Artificial; identical to SEQ ID NO: 1795
  TaSBEIIa-A allele with mutations introduced by TALEN pair TaSBEIIa_T03

SEQ ID NO: 2041 - DNA, 494 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtagcggtggtttttttgtttgcaagcagcagattacgcgcagaaaaaaggaaggtcctggtgcctgaacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 2042 - DNA, 475 bp, Artificial; identical to SEQ ID NO: 1735
  TaSBEIIa-A allele with mutations introduced by TALEN pair TaSBEIIa_T03

SEQ ID NO: 2043 - DNA, 415 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtgg

SEQ ID NO: 2044 - DNA, 480 bp, Artificial; identical to SEQ ID NO: 2032
  TaSBEIIa-A allele with mutations introduced by TALEN pair TaSBEIIa_T03

SEQ ID NO: 2045 - DNA, 416 bp, Artificial; identical to SEQ ID NO: 1786
  TaSBEIIa-A allele with mutations introduced by TALEN pair TaSBEIIa_T03

SEQ ID NO: 2046 - DNA, 476 bp, Artificial; identical to SEQ ID NO: 1772
  TaSBEIIa-A allele with mutations introduced by TALEN pair TaSBEIIa_T03

SEQ ID NO: 2047 - DNA, 442 bp, Artificial; identical to SEQ ID NO: 1795
  TaSBEIIa-A allele with mutations introduced by TALEN pair TaSBEIIa_T03

SEQ ID NO: 2048 - DNA, 443 bp, Artificial; identical to SEQ ID NO: 1732
  TaSBEIIa-A allele with mutations introduced by TALEN pair TaSBEIIa_T03

SEQ ID NO: 2049 - DNA, 441 bp, Artificial; identical to SEQ ID NO: 1758
  TaSBEIIa-A allele with mutations introduced by TALEN pair TaSBEIIa_T03

SEQ ID NO: 2050 - DNA, 439 bp, Artificial; identical to SEQ ID NO: 1753
  TaSBEIIa-A allele with mutations introduced by TALEN pair TaSBEIIa_T03

SEQ ID NO: 2051 - DNA, 448 bp, Artificial; identical to SEQ ID NO: 1797
  TaSBEIIa-A allele with mutations introduced by TALEN pair TaSBEIIa_T03

SEQ ID NO: 2052 - DNA, 494 bp, Artificial; identical to SEQ ID NO: 1991
  TaSBEIIa-A allele with mutations introduced by TALEN pair TaSBEIIa_T03

SEQ ID NO: 2053 - DNA, 481 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaagtcacgttatgacccccgccgatgacgcgggacaagccgttttacgtttggaactgaggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 2054 - DNA, 442 bp, Artificial; identical to SEQ ID NO: 1795
  TaSBEIIa-A allele with mutations introduced by TALEN pair TaSBEIIa_T03

SEQ ID NO: 2055 - DNA, 411 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttggg

SEQ ID NO: 2056 - DNA, 507 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctcttgggccactg

SEQ ID NO: 2057 - DNA, 441 bp, Artificial; identical to SEQ ID NO: 1758
  TaSBEIIa-A allele with mutations introduced by TALEN pair TaSBEIIa_T03

SEQ ID NO: 2058 - DNA, 509 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttccccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttttgagcttcttctatcagcattgtgcag

SEQ ID NO: 2059 - DNA, 441 bp, Artificial; identical to SEQ ID NO: 1748
  TaSBEIIa-A allele with mutations introduced by TALEN pair TaSBEIIa_T03

SEQ ID NO: 2060 - DNA, 441 bp, Artificial; identical to SEQ ID NO: 1758
  TaSBEIIa-A allele with mutations introduced by TALEN pair TaSBEIIa_T03

SEQ ID NO: 2061 - DNA, 442 bp, Artificial; identical to SEQ ID NO: 1795
  TaSBEIIa-A allele with mutations introduced by TALEN pair TaSBEIIa_T03

SEQ ID NO: 2062 - DNA, 535 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttttgagcttcttctatcagcatgtgcagtactgcactgccttgtgcatttttgttt

SEQ ID NO: 2063 - DNA, 421 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgct

SEQ ID NO: 2064 - DNA, 441 bp, Artificial; identical to SEQ ID NO: 1748
  TaSBEIIa-A allele with mutations introduced by TALEN pair TaSBEIIa_T03

SEQ ID NO: 2065 - DNA, 442 bp, Artificial; identical to SEQ ID NO: 1795
  TaSBEIIa-A allele with mutations introduced by TALEN pair TaSBEIIa_T03

SEQ ID NO: 2066 - DNA, 440 bp, Artificial; identical to SEQ ID NO: 1713
  TaSBEIIa-A allele with mutations introduced by TALEN pair TaSBEIIa_T03

SEQ ID NO: 2067 - DNA, 441 bp, Artificial; identical to SEQ ID NO: 1748
  TaSBEIIa-A allele with mutations introduced by TALEN pair TaSBEIIa_T03

SEQ ID NO: 2068 - DNA, 492 bp, Artificial; identical to SEQ ID NO: 1977
  TaSBEIIa-A allele with mutations introduced by TALEN pair TaSBEIIa_T03

SEQ ID NO: 2069 - DNA, 442 bp, Artificial; identical to SEQ ID NO: 1731
  TaSBEIIa-A allele with mutations introduced by TALEN pair TaSBEIIa_T03

SEQ ID NO: 2070 - DNA, 489 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggatcgcccatgactagcaggtaagggcgaaaactcacgttaagggattttggtcatgagattatcaaaagtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgc

SEQ ID NO: 2071 - DNA, 442 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctccccattctgatattttctcactctttcttctgttcttgctgtaactgcaagttgtagcattgtctcactattgtagtcatccttgcattgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 2072 - DNA, 558 bp, Artificial
  TaSBEIIa-A allele with mutations introduced by TALEN pair TaSBEIIa_T03
  misc_feature (295): n is a or c or t or g
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacgccacctctgacttgagcgtcgattttttgtgatgctcgtcaggggggcggagcctatggaaaaacgccagcaacgcggccttttttacggttccnggcccttttgctggccttttgctaaggtcctggtgcctgacggtgagagcgacgacttggcaagtccggcgcaacctgaagaattacaggtacacaccatcgtgccgggaaaatcttcatacaatcgttattcacttaccaaatgccggatgaaaccaagccgcggaggcgtcaggttttgagcttcttctatcagcattgtgcagtactgcactgccttgtgcatttgttagccgtggcccgtgctggctcttgggccactg

SEQ ID NO: 2073 - DNA, 444 bp, Artificial; identical to SEQ ID NO: 2003
  TaSBEIIa-A allele with mutations introduced by TALEN pair TaSBEIIa_T03

SEQ ID NO: 2074 - DNA, 440 bp, Artificial; identical to SEQ ID NO: 1713
  TaSBEIIa-A allele with mutations introduced by TALEN pair TaSBEIIa_T03

SEQ ID NO: 2075 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggccttctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 2076 - DNA, 441 bp, Artificial; identical to SEQ ID NO: 1748
  TaSBEIIa-A allele with mutations introduced by TALEN pair TaSBEIIa_T03

SEQ ID NO: 2077 - DNA, 440 bp, Artificial; identical to SEQ ID NO: 1713
  TaSBEIIa-A allele with mutations introduced by TALEN pair TaSBEIIa_T03

SEQ ID NO: 2078 - DNA, 559 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacgccacctctgacttgagcgtcgattttttgtgatgctcgtcaggggggcggagcctatggaaaaacgccagcaacgcggccttttttacggttcctggcccttttgctggccttttgctaaggtcctggtgcctgacggtgagagcgacgacttggcaagtccggcgcaacctgaagaattacaggtacacaccatcgtgccgggaaaatcttcatacaatcgttattcacttaccaaatgccggatgaaaccaagccgcggaggcgtcaggttttgagcttcttctatcagcattgtgcagtactgcactgccttgtgcattttgttagccgtggcccgtgctggctcttgggccactg

SEQ ID NO: 2079 - DNA, 428 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgccctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctc

SEQ ID NO: 2080 - DNA, 428 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctc

SEQ ID NO: 2081 - DNA, 442 bp, Artificial; identical to SEQ ID NO: 1795
  TaSBEIIa-A allele with mutations introduced by TALEN pair TaSBEIIa_T03

SEQ ID NO: 2082 - DNA, 465 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggggaattttatggaacgtcagtggagcattttttcccctcggtatccaattagagtctcatattcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgc

SEQ ID NO: 2083 - DNA, 493 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtagcggtggttttttttgtttgcaagcagcagattacgcgcagaaaaaaggaaggtcctggtgcctgacggtgagagcgacgacttggcaagtccggcgcacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 2084 - DNA, 440 bp, Artificial; identical to SEQ ID NO: 1713
  TaSBEIIa-A allele with mutations introduced by TALEN pair TaSBEIIa_T03

SEQ ID NO: 2085 - DNA, 557 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacgccacctctgacttgagcgtcgattttttgtgatgctcgtcagggggcggagcctatggaaaaacgccagcaacgcggccttttttacggttcctggcccttttgctggccttttgctaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccgtgctggctcttgggccactg

SEQ ID NO: 2086 - DNA, 443 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttctttctgttcttgctgtaactgcaagttgtagcattgtctcactattgtagtcatccttgcattgcaggcgccgtcctgagccgcgcggcctctccaaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 2087 - DNA, 441 bp, Artificial; identical to SEQ ID NO: 1748
  TaSBEIIa-A allele with mutations introduced by TALEN pair TaSBEIIa_T03

SEQ ID NO: 2088 - DNA, 554 bp, Artificial; identical to SEQ ID NO: 1855
  TaSBEIIa-A allele with mutations introduced by TALEN pair TaSBEIIa_T03
  misc_feature (291): n is a or c or t or g

SEQ ID NO: 2089 - DNA, 473 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggggaatttatggaacgtcagtggagcatttttcccctcggtatccaattagagtctcatattcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttag

SEQ ID NO: 2090 - DNA, 440 bp, Artificial; identical to SEQ ID NO: 1882
  TaSBEIIa-A allele with mutations introduced by TALEN pair TaSBEIIa_T03

SEQ ID NO: 2091 - DNA, 441 bp, Artificial; identical to SEQ ID NO: 1716
  TaSBEIIa-A allele with mutations introduced by TALEN pair TaSBEIIa_T03

SEQ ID NO: 2092 - DNA, 441 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggatgcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactg

SEQ ID NO: 2093 - DNA, 439 bp, Artificial; identical to SEQ ID NO: 1753
  TaSBEIIa-A allele with mutations introduced by TALEN pair TaSBEIIa_T03

SEQ ID NO: 2094 - DNA, 410 bp, Artificial; identical to SEQ ID NO: 1783
  TaSBEIIa-A allele with mutations introduced by TALEN pair TaSBEIIa_T03

SEQ ID NO: 2095 - DNA, 443 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgctggctccttgggccactgaa

SEQ ID NO: 2096 - DNA, 442 bp, Artificial; identical to SEQ ID NO: 1795
  TaSBEIIa-A allele with mutations introduced by TALEN pair TaSBEIIa_T03

SEQ ID NO: 2097 - DNA, 440 bp, Artificial; identical to SEQ ID NO: 1713
  TaSBEIIa-A allele with mutations introduced by TALEN pair TaSBEIIa_T03

SEQ ID NO: 2098 - DNA, 481 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggatcgcccatgactagcaggtaagggcgaaaactcacgttaagggattttggtcatgagattatcaaaagtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtgg

SEQ ID NO: 2099 - DNA, 443 bp, Artificial; identical to SEQ ID NO: 1732
  TaSBEIIa-A allele with mutations introduced by TALEN pair TaSBEIIa_T03

SEQ ID NO: 2100 - DNA, 402 bp, Artificial
  TaSBEIIa-A allele with mutations introduced by TALEN pair TaSBEIIa_T03
gagatagctggattaggcgatcgccatgcgtcagtgtcacccaggccctggtagttatcacggctttgatcatctcctcccattctgatattttctcactctttcttctgttcttgctgtaactgcaagttgtagcattgtctcaactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaaatcgttattcacttaccaaatgccggatgaaaccaagccgcggaggcgtcaggttttgagcttcttctatcaagcattgtgcagtactgcactgccttgtgc

SEQ ID NO: 2101 - DNA, 440 bp, Artificial; identical to SEQ ID NO: 1713
  TaSBEIIa-A allele with mutations introduced by TALEN pair TaSBEIIa_T03

SEQ ID NO: 2102 - DNA, 443 bp, Artificial; identical to SEQ ID NO: 1722
  TaSBEIIa-A allele with mutations introduced by TALEN pair TaSBEIIa_T03

SEQ ID NO: 2103 - DNA, 508 bp, Artificial; identical to SEQ ID NO: 1839
  TaSBEIIa-A allele with mutations introduced by TALEN pair TaSBEIIa_T03

SEQ ID NO: 2104 - DNA, 436 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggcccact

SEQ ID NO: 2105 - DNA, 526 bp, Artificial
  TaSBEIIa-A allele with mutations introduced by TALEN pair TaSBEIIa_T03
  misc_feature (291): n is a or c or t or g
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacgccacctctgacttgagcgtcgatttttgtgatgctcgtcagggggcggagcctatgaaaaacgccagcaacgcggcctttttacggttccnggccctttttgctggccttttgctaaggtcctggtgcctgacggtgagagcgacgacttggcaagtccggcgcaacctgaagaattacaggtacacaccatcgtgccgggaaaatcttcatacaatcgttattcacttaccaaatgccggatgaaaccaagccgcggaggcgtcaggttttgagcttcttctatcagcattgtgcagtactgcactgccttgtgcattttgttag

SEQ ID NO: 2106 - DNA, 442 bp, Artificial
  TaSBEIIa-A allele with mutations introduced by TALEN pair TaSBEIIa_T03
gagatagctggattaggcgatcgcctgcgtcagtgtcaccccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 2107 - DNA, 516 bp, Artificial; identical to SEQ ID NO: 1884
  TaSBEIIa-A allele with mutations introduced by TALEN pair TaSBEIIa_T03

SEQ ID NO: 2108 - DNA, 439 bp, Artificial; identical to SEQ ID NO: 1753
  TaSBEIIa-A allele with mutations introduced by TALEN pair TaSBEIIa_T03

SEQ ID NO: 2109 - DNA, 441 bp, Artificial; identical to SEQ ID NO: 1748
  TaSBEIIa-A allele with mutations introduced by TALEN pair TaSBEIIa_T03

SEQ ID NO: 2110 - DNA, 475 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggggaattttatggaacgtcagtggagcattttttcccctcggtatccaattagagtctcatattcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttag

SEQ ID NO: 2111 - DNA, 483 bp, Artificial
  TaSBEIIa-A allele with mutations introduced by TALEN pair TaSBEIIa_T03
  misc_feature (377): n is a or c or t or g
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatacaatcgttattcncttaccaaatgccggatgaaaccaagccgcggaggcgtcaggttttgagcttcttctatcagcattgtgcagtactgcactgccttgtgcattttgttagccgtgg

SEQ ID NO: 2112 - DNA, 471 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcacggcctctccaagtcacgttatgacccccgccgatgacgcgggacaagccgttttacgtttggaactgaggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctctt

SEQ ID NO: 2113 - DNA, 501 bp, Artificial; identical to SEQ ID NO: 2017
  TaSBEIIa-A allele with mutations introduced by TALEN pair TaSBEIIa_T03
  misc_feature (441): n is a or c or t or g

SEQ ID NO: 2114 - DNA, 481 bp, Artificial; identical to SEQ ID NO: 2053
  TaSBEIIa-A allele with mutations introduced by TALEN pair TaSBEIIa_T03

SEQ ID NO: 2115 - DNA, 440 bp, Artificial; identical to SEQ ID NO: 1713
  TaSBEIIa-A allele with mutations introduced by TALEN pair TaSBEIIa_T03

SEQ ID NO: 2116 - DNA, 440 bp, Artificial; identical to SEQ ID NO: 1713
  TaSBEIIa-A allele with mutations introduced by TALEN pair TaSBEIIa_T03

SEQ ID NO: 2117 - DNA, 440 bp, Artificial; identical to SEQ ID NO: 1713
  TaSBEIIa-A allele with mutations introduced by TALEN pair TaSBEIIa_T03

SEQ ID NO: 2118 - DNA, 440 bp, Artificial; identical to SEQ ID NO: 1713
  TaSBEIIa-A allele with mutations introduced by TALEN pair TaSBEIIa_T03

SEQ ID NO: 2119 - DNA, 442 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctccccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 2120 - DNA, 429 bp, Artificial; identical to SEQ ID NO: 1782
  TaSBEIIa-A allele with mutations introduced by TALEN pair TaSBEIIa_T03

SEQ ID NO: 2121 - DNA, 440 bp, Artificial; identical to SEQ ID NO: 1713
  TaSBEIIa-A allele with mutations introduced by TALEN pair TaSBEIIa_T03

SEQ ID NO: 2122 - DNA, 442 bp, Artificial; identical to SEQ ID NO: 1795
  TaSBEIIa-A allele with mutations introduced by TALEN pair TaSBEIIa_T03

SEQ ID NO: 2123 - DNA, 558 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctccccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctctt

SEQ ID NO: 2124 - DNA, 441 bp, Artificial; identical to SEQ ID NO: 1748
  TaSBEIIa-A allele with mutations introduced by TALEN pair TaSBEIIa_T03

SEQ ID NO: 2125 - DNA, 416 bp, Artificial
  TaSBEIIa-A allele with mutations introduced by TALEN pair TaSBEIIa_T03
gagatagctggattaggcgatcgcctgcgtcagtgtcaccccaggcccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttctacaatcgttattctacttaccaaatgccggatgaaacccaagccgcggaggcgtcaggttttgagcttcttctatcagcattgtgcagtactgcactgccttgtgcatttttgttagccgtgg

SEQ ID NO: 2126 - DNA, 458 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacttggtctgacagttaccaatgcttaatcagtgaggcacctatctcagcgaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctattcagcattgtgcagtactgcactgccttgtgcattttgttag

SEQ ID NO: 2127 - DNA, 559 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttttgagcttcttctatcagcattgtgcagttactgcactgccttgtgcatttttgtttagccgtggccccgtgctggctc

SEQ ID NO: 2128 - DNA, 441 bp, Artificial; identical to SEQ ID NO: 2011
  TaSBEIIa-A allele with mutations introduced by TALEN pair TaSBEIIa_T03

SEQ ID NO: 2129 - DNA, 441 bp, Artificial; identical to SEQ ID NO: 1758
  TaSBEIIa-A allele with mutations introduced by TALEN pair TaSBEIIa_T03

SEQ ID NO: 2130 - DNA, 440 bp, Artificial; identical to SEQ ID NO: 1713
  TaSBEIIa-A allele with mutations introduced by TALEN pair TaSBEIIa_T03

SEQ ID NO: 2131 - DNA, 499 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggttttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggccccgtgctggctctt

SEQ ID NO: 2132 - DNA, 501 bp, Artificial; identical to SEQ ID NO: 1906
  TaSBEIIa-A allele with mutations introduced by TALEN pair TaSBEIIa_T03

SEQ ID NO: 2133 - DNA, 422 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgctgct

SEQ ID NO: 2134 - DNA, 440 bp, Artificial
  TaSBEIIa-A allele with mutations introduced by TALEN pair TaSBEIIa_T03
gagatagctggattaggcgatcgcctgcgtcagtgcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccagggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 2135 - DNA, 471 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggggaatttatggaacgtcagtggagcattttccctcggtatccaattagagtctcatattcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttttgagcttcttctatcagcattgtgcagtactgcactgccttgtgcattttgttag

SEQ ID NO: 2136 - DNA, 454 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaagtcacgttatgaccccgccgcatgacgcggagcaagccgttttacgtttggaactgaggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtgg

SEQ ID NO: 2137 - DNA, 480 bp, Artificial; identical to SEQ ID NO: 2032
  TaSBEIIa-A allele with mutations introduced by TALEN pair TaSBEIIa_T03

SEQ ID NO: 2138 - DNA, 427 bp, Artificial; identical to SEQ ID NO: 1849
  TaSBEIIa-A allele with mutations introduced by TALEN pair TaSBEIIa_T03

SEQ ID NO: 2139 - DNA, 442 bp, Artificial; identical to SEQ ID NO: 1717
  TaSBEIIa-A allele with mutations introduced by TALEN pair TaSBEIIa_T03

SEQ ID NO: 2140 - DNA, 501 bp, Artificial; identical to SEQ ID NO: 2017
  TaSBEIIa-A allele with mutations introduced by TALEN pair TaSBEIIa_T03
  misc_feature (441): n is a or c or t or g

SEQ ID NO: 2141 - DNA, 508 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctccccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttttgagcttcttctatcagcattgtgca

SEQ ID NO: 2142 - DNA, 491 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtagcggtggttttttgttgcaagcagcagtattacgcgcagaaaaaaggaaggtcctggtgcctgaacggtggagcgacgacttggcaagtccggcgcacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 2143 - DNA, 441 bp, Artificial; identical to SEQ ID NO: 1748
  TaSBEIIa-A allele with mutations introduced by TALEN pair TaSBEIIa_T03

SEQ ID NO: 2144 - DNA, 558 bp, Artificial
  TaSBEIIa-A allele with mutations introduced by TALEN pair TaSBEIIa_T03
  misc_feature (294): n is a or c or t or g
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacgccacctctgacttgagcgtcgattttttgtgatgctcgtcagggggcggagcctatggaaaaacgccagcaacgcggccttttttacggttccnggccctttttgctggcctttttgctaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttgttagccgtggcccgtgctggctcttgggccactg

SEQ ID NO: 2145 - DNA, 449 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacttggtctgacagttaccaatgcttaatcagtgaggcacctatctcagcgaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctattcagcattgtgcagtactgcactgccttgtgca

SEQ ID NO: 2146 - DNA, 468 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggatcgccccatgactagcaggtaaggggcgaaaactcacgttaagggattttggtcatgagattatcaaaagtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgca

SEQ ID NO: 2147 - DNA, 520 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacgccacctctgacttgagcgtcgattttttgtgatgctcgtcagggggcggagcctatggaaaaacgccagcaacgcggccttttttacggttcctggcccttttgctggcctttttgctaaggtcctggtgcctgacggtgagagcgacgacttggcaagtccggcgcaacctgaagaattacaggtacacaccatcgtgccgggaaaatcttcatacaatcgttattcacttaccaaatgccggatgaaaccaagccgcggaggcgtcaggttttgagcttcttctatcagcattgtgcagtactgcactgccttgtgca

SEQ ID NO: 2148 - DNA, 441 bp, Artificial; identical to SEQ ID NO: 1748
  TaSBEIIa-A allele with mutations introduced by TALEN pair TaSBEIIa_T03

SEQ ID NO: 2149 - DNA, 481 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcacggcctctccaagtcacgttatgacccccgccgatgacgcgggacaagccgttttacgtttggaactgaggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 2150 - DNA, 463 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacttggtctgacagttaccaatgcttgaatcagtgaggcaccctatctcagcgaggtcctggtgcctgacggtgagagcgacgacttggcaagtccggcgcaacctgaagaattacaggtacacaccatcgtgcccgggaaatcttcatacaatcgttattcacttaccaaatgccggatgaaaccaagccgcggaggcgtcaggtttttgagcttcttctatcagcatttgtgcagtactgcactgccttgtgcatttttgttag

SEQ ID NO: 2151 - DNA, 507 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggcccgtgctggctcttgggccactg

SEQ ID NO: 2152 - DNA, 442 bp, Artificial
  TaSBEIIa-A allele with mutations introduced by TALEN pair TaSBEIIa_T03
gagatagctggattaggcgatcgcctgcgtcagtgtcaccccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 2153 - DNA, 395 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgc

SEQ ID NO: 2154 - DNA, 442 bp, Artificial; identical to SEQ ID NO: 1795
  TaSBEIIa-A allele with mutations introduced by TALEN pair TaSBEIIa_T03

SEQ ID NO: 2155 - DNA, 535 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgctctagatccaatgatcatgagcggagaattaagggagtcacgttaaggtcctggtgcctgacggtgagagcgacgacttggcaagtccggcgcaacctgaagaattacagggtacacaccatcgtgccgggaaatcttcatacaatcgttattcacttaccaaatgccggatgaaaccaaccacggatgcgtcaggtttcgagcttcttctatcagcattgtgcaggtatctgcatctgccttgttcattttgtt

SEQ ID NO: 2156 - DNA, 440 bp, Artificial; identical to SEQ ID NO: 1713
  TaSBEIIa-A allele with mutations introduced by TALEN pair TaSBEIIa_T03

SEQ ID NO: 2157 - DNA, 441 bp, Artificial; identical to SEQ ID NO: 2011
  TaSBEIIa-A allele with mutations introduced by TALEN pair TaSBEIIa_T03

SEQ ID NO: 2158 - DNA, 482 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtagcggtggtttttttgtttgcaagcagcagattacgcgcagaaaaaaggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctctt

SEQ ID NO: 2159 - DNA, 442 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatccatctcctccccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 2160 - DNA, 440 bp, Artificial; identical to SEQ ID NO: 1713
  TaSBEIIa-A allele with mutations introduced by TALEN pair TaSBEIIa_T03

SEQ ID NO: 2161 - DNA, 529 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcgggaggcgtcaggtttttgagcttcttctatcagcattgtgcagtactgcactgccttgtgca

SEQ ID NO: 2162 - DNA, 430 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctccccattctgatattttctcactctttctttctgttcttgctgttaactgcaagttgtagcattgtctcactattgtagtcatccttgcattgcaggcgccgtcctgagccgcgcggcctctccaaaggtcctggtgccctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctgg

SEQ ID NO: 2163 - DNA, 528 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacgccacctctgacttgagcgtcgattttttgtgatgctcgtcaggggggcggagcctatggaaaaacgccagcaacgcggccttttttacggttcctggcccttttgctggcctttttgctaaggtcctggtgcctgacggtgagagcgacgacttggcaagtccggcgcaacctgaagattacaggtacacaccatcgtgccgggaaaatcttcatacaatcgttattcacttaccaaatgccggatgaaaccaagccgcggaggcgtcaggttttgagcttcttctatcagcattgtgcagtactgcactgccttgtgcatttgttag

SEQ ID NO: 2164 - DNA, 559 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccaggggttttccccagtcacgacgttgtaaaaacgacggccagtgaattcgagctcggtacctcgcgaatgcatctagatccaatgatcatgagcggagaattaagggagtcacgttaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggtttttgagcttcttctatcagcattgtgcagtactgcactgccttgtgcattttgttagccgtggccccgtgctggctc

SEQ ID NO: 2165 - DNA, 480 bp, Artificial; identical to SEQ ID NO: 2020
  TaSBEIIa-A allele with mutations introduced by TALEN pair TaSBEIIa_T03

SEQ ID NO: 2166 - DNA, 442 bp, Artificial; identical to SEQ ID NO: 1795
  TaSBEIIa-A allele with mutations introduced by TALEN pair TaSBEIIa_T03

SEQ ID NO: 2167 - DNA, 515 bp, Artificial
  TaSBEIIa-A allele with mutations introduced by TALEN pair TaSBEIIa_T03
gagatagctggattaggcgatcgcctgcgtcagtgtcacccaggccctggtcgttgattcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggggaattttatggaaacgtcagtggagcattttttcccctcggtatccaattagagtctcatattcaaggtcctggtgcctgacggtgagagcgacgacttggcaagtccggcgcaacctgaagaattacaggtacacaccatcgtgccgggaaatcttcatacaatcgttattcacttaccaaatgccggatgaaaaccaagccgcggaggcgtcaggtttttgagcttcttctatcagcattgtgcagtactgcactgccttgtgcattttgttagcccgtggccccgtgctggctctttgggccactgaa

SEQ ID NO: 2168 - DNA, 441 bp, Artificial; identical to SEQ ID NO: 1748
  TaSBEIIa-A allele with mutations introduced by TALEN pair TaSBEIIa_T03

SEQ ID NO: 2169 - DNA, 493 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtagcggtggttttttttgtttgcaagcagcagattacgcgcagaaaaaaaggaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactg

SEQ ID NO: 2170 - DNA, 444 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctccccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatccccttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 2171 - DNA, 440 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacccgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 2172 - DNA, 416 bp, Artificial; identical to SEQ ID NO: 1786
  TaSBEIIa-A allele with mutations introduced by TALEN pair TaSBEIIa_T03

SEQ ID NO: 2173 - DNA, 424 bp, Artificial
  TaSBEIIa-A allele with mutations introduced by TALEN pair TaSBEIIa_T03
gagatagctggattaggcgatcgcctgcgtcagtgtcacccaggcccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctcaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctgg

SEQ ID NO: 2174 - DNA, 480 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcacggcctctccaagtcacgttatgacccccgccgatgacgcgggacaagccgttttacgtttggaactgaggtgagagcgacgacttggcaagtccggcgcacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactgaa

SEQ ID NO: 2175 - DNA, 428 bp, Artificial
  TaSBEIIa-A allele with mutations introduced by TALEN pair TaSBEIIa_T03
gagatagctggattaggcgatcgcctgcgtcagtgtcacccaggcccggtgttatcacggctttgatcactcctcccattcgatattttctcactctttcttctgttcttgctgtaactgcaagttgtagcatgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttggg

SEQ ID NO: 2176 - DNA, 506 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctctaagttgggtaacgccagggttttcccagtcacgacgttgtaaaacgacggccagtgaattcgagctcggtacctcgcgaatgcatctagatccaatgatcatgagcggagaattaagggagtcacgttaaggtcctggtgcctgacggtgagagcgacgactttggcaagttccggcgcaacctgaagaattacaggtacacaccatcgtgccgggaaatcttcatacaatcgttattcacttaccaaatgccggatgaaaccaagccgcgggagcgtcaggtttttgagcttcttctatcagcatgtg

SEQ ID NO: 2177 - DNA, 506 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggatcgcccatgactagcaggtaagggcgaaaactcacgttaagggattttggtcatgagattatcaaaagtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagcccgtggccccgtgctggctcttgggccact

SEQ ID NO: 2178 - DNA, 415 bp, Artificial; identical to SEQ ID NO: 2043
  TaSBEIIa-A allele with mutations introduced by TALEN pair TaSBEIIa_T03

SEQ ID NO: 2179 - DNA, 555 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccacgccacctctgacttgagcgtcgattttttgtgatgctcgtcagggggcggagcctatgaaaaacgccagcaacgcggcctttttacggttcctggcccttttgctggccttttgctaaggtcctggtgcctgacggtgagagcgacgacttggcaagtccggcgcaacctgaagaattacaggtacacaccatcgtgccgggaaaatcttcatacaatcgttattcacttaccaaatgccggatgaaaccaagccgcggaggcgtcaggttttgagcttcttctatcagcattgtgcagtactgcactgccttgtgcatttgttagccgtggcccgtgctggctcttgggccactg

SEQ ID NO: 2180 - DNA, 484 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcctctccaggtagcggtggtttttttgtttgcaagcagcagattacgcgcagaaaaaaggaaggtcctggtgcctgacggtgagagcgacgacttggcaagtccggcgcacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttggg

SEQ ID NO: 2181 - DNA, 429 bp, Artificial; identical to SEQ ID NO: 1720
  TaSBEIIa-A allele with mutations introduced by TALEN pair TaSBEIIa_T03

SEQ ID NO: 2182 - DNA, 439 bp, Artificial
  TaSBEIIa-A allele with mutations introduced by TALEN pair TaSBEIIa_T03
gagatagctggattaggcgatcgcctgcgtcagtgtcacccaggccctggtgttatcacggctttgatcatctcctcccattctgatatttttctcactctttcttctgttcttgctgtaactgcaagttgtagcattgtctcactattgtagtcatccttgcattgcaggcgccgtcctgagccgcgcggcctctccaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggcccccgtgctggctcttgggccact

SEQ ID NO: 2183 - DNA, 397 bp, Artificial
  TaSBEIIa-A allele with mutations introduced by TALEN pair TaSBEIIa_T03
gagatagctggattaggcgatcgcccgcgtcagtgtcacccaggccctggtgttatcacagctttgatcatctcctcccattctgatattttctcactctttcttctgttcttgctgtaactgcaagttgtagcattgtctcactattgtagtcatccttgcattgcaggcgcgtcctgagccgcgcggcctctccaggtcctggtgcctgacggtgagagcgacgacttggcaagtccggcgcaacctgaagaaattacaggtacacaccatcgtgccgggaaatcttcatacaatcgttattcacttaccaaatgccggatgaaaccaagccgcggaggcgtcaggttttgagcttcttctatcaagcattgtgcagtactgcactgccttgtgc

SEQ ID NO: 2184 - DNA, 481 bp, Artificial
  TaSBEIIa-A allele with mutations introduced by TALEN pair TaSBEIIa_T03
gagatagctggattaggcgatcgcctgcgtcgagtcacccaggccctggtgttatcacggctttgatcatctcctcccattctgatattttctcactctttcttctgttcttgctgtaactgcaagttgtagcattgtctcactattgtagtcatccttgcattgcaggcgccgtcctgagccgcgcggcggcggtttgcgtattgggcgctcttccgcttcctcgctcactgactcgctgcgctcggtcgttcggctgcggcgagcaggtcctggtgcctgacggtgagagcgacgacttggcaagtccggcgcaacctgaagaattacaggtacacaccatcgtgccggggaaatcttcatacaatcgttattcacttaccaaatgccggatgaaaccaagccgcggaggcgtcaggttttgagcttcttctatcagcattgtgcagtactgcactgccttgtgcattttgttagccgt

SEQ ID NO: 2185 - DNA, 440 bp, Artificial; identical to SEQ ID NO: 1713
  TaSBEIIa-A allele with mutations introduced by TALEN pair TaSBEIIa_T03

SEQ ID NO: 2186 - DNA, 434 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccg

SEQ ID NO: 2187 - DNA, 425 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctctggtgcctgacggtgagagcgacgacttggcggccactccagcgcaacccgaagaattacaggtacacaccgtcgtgccggaaaatcttcatgcacccgtttattcacttaccaaatatcggatgaaccaagccgcggaggcatcaggtttcaagcttcttctatcagcattgtgcactacttcactgccttgtgcagtttgttagctgtggccc

SEQ ID NO: 2188 - DNA, 426 bp, Artificial
  TaSBEIIa-B allele with mutations introduced by TALEN pair TaSBEIIa_T03
gagatagctggattaggcgatcgcctcaggccctggtgttatccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattatcaggtacacaccgtcgtgccggaaaatcttcatgcaccgttattcacttaccaaatatcggatgaaccaagccgcggaggcatcaggtttcaagcttcttctatcagcattgtgcactacttcactgccttgtgcagtttgttagctgtggccc

SEQ ID NO: 2189 - DNA, 427 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccg

SEQ ID NO: 2190 - DNA, 442 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggc

SEQ ID NO: 2191 - DNA, 429 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2192 - DNA, 423 bp, Artificial
  TaSBEIIa-B allele with mutations introduced by TALEN pair TaSBEIIa_T03
  misc_feature (164): n is a or c or t or g
gagatagctggattaggcgatcgcctcaggccctggtgttaccacggctttgatcatctcctcctttcatgctgatatttttctcactctttcttctgttcttgctgtaactgcaagttgtagcattttttggcaaataagttgtagcattgtctcagtattgnactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2193 - DNA, 437 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgc

SEQ ID NO: 2194 - DNA, 446 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2195 - DNA, 441 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggct

SEQ ID NO: 2196 - DNA, 448 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcgtt

SEQ ID NO: 2197 - DNA, 435 bp, Artificial
  TaSBEIIa-B allele with mutations introduced by TALEN pair TaSBEIIa_T03
gagatagctggattaggcgatcgcctcaggccctggtgttatccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccg

SEQ ID NO: 2198 - DNA, 436 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgc

SEQ ID NO: 2199 - DNA, 435 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggc

SEQ ID NO: 2200 - DNA, 500 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccagcgtttctgggtgagcaaaacaggaaggcaaatgccgcaaaaagggaaggtcctggtgcctgacggtgagagcgacgacttggcggccactccagcgcaacccgaagaattacaggtacacaccgtcgtgccggaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2201 - DNA, 431 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgc

SEQ ID NO: 2202 - DNA, 452 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2203 - DNA, 427 bp, Artificial
  TaSBEIIa-B allele with mutations introduced by TALEN pair TaSBEIIa_T03
gagatagctggattaggcgatcgcctcaggccctgctgttatccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagc

SEQ ID NO: 2204 - DNA, 433 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggc

SEQ ID NO: 2205 - DNA, 431 bp, Artificial; identical to SEQ ID NO: 2201
  TaSBEIIa-B allele with mutations introduced by TALEN pair TaSBEIIa_T03

SEQ ID NO: 2206 - DNA, 437 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgc

SEQ ID NO: 2207 - DNA, 436 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccg

SEQ ID NO: 2208 - DNA, 430 bp, Artificial
  TaSBEIIa-B allele with mutations introduced by TALEN pair TaSBEIIa_T03
gagatagctggattaggcgatcgcctcaggccctggtgttatccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2209 - DNA, 431 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctc

SEQ ID NO: 2210 - DNA, 430 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttggcaaataagttgtagcattgtctcagtattgtactcatccttgcatttgcaggcgccgtcctgagccgcgcggcctctcgtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggc

SEQ ID NO: 2211 - DNA, 452 bp, Artificial; identical to SEQ ID NO: 2202
  TaSBEIIa-B allele with mutations introduced by TALEN pair TaSBEIIa_T03

SEQ ID NO: 2212 - DNA, 424 bp, Artificial
  TaSBEIIa-B allele with mutations introduced by TALEN pair TaSBEIIa_T03
gagatagctggattaggcgatcgcctcaggccctgctgttatccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctctggtgcctgacggtgagagcgacgacttggcggccactccagcgcaacccgaagaattacaggtacacaccgtcgtgccggaaaatcttcatgcacccgtctattcacttaccaaatatcggatgaaccaagccgcggaggcatcaggtttcaagcttcttctatcagcattgtgcactacttcactgccttgtgcagtttgttagctgtgg

SEQ ID NO: 2213 - DNA, 452 bp, Artificial; identical to SEQ ID NO: 2202
  TaSBEIIa-B allele with mutations introduced by TALEN pair TaSBEIIa_T03

SEQ ID NO: 2214 - DNA, 452 bp, Artificial; identical to SEQ ID NO: 2202
  TaSBEIIa-B allele with mutations introduced by TALEN pair TaSBEIIa_T03

SEQ ID NO: 2215 - DNA, 443 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggc

SEQ ID NO: 2216 - DNA, 416 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2217 - DNA, 445 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2218 - DNA, 497 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccagggcgagcggtatcagctcactcaaaggcggtaatacggttatccacagaatcagggaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgct

SEQ ID NO: 2219 - DNA, 445 bp, Artificial; identical to SEQ ID NO: 2217
  TaSBEIIa-B allele with mutations introduced by TALEN pair TaSBEIIa_T03

SEQ ID NO: 2220 - DNA, 445 bp, Artificial; identical to SEQ ID NO: 2217
  TaSBEIIa-B allele with mutations introduced by TALEN pair TaSBEIIa_T03

SEQ ID NO: 2221 - DNA, 440 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaaatcttcatgcacccgttattcacttaccaaatatcggatgaaccaagccgcggaggcatcaggtttcaagcttcttctatcagcattgtgcactacttcactgccttgtgcagtttgttagctgtggccccgccgc

SEQ ID NO: 2222 - DNA, 445 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2223 - DNA, 429 bp, Artificial
  TaSBEIIa-B allele with mutations introduced by TALEN pair TaSBEIIa_T03
gagatagctggattaggcgatcgcctcaggccctgtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2224 - DNA, 422 bp, Artificial
  TaSBEIIa-B allele with mutations introduced by TALEN pair TaSBEIIa_T03
gagatagctggattaggcgatcgcctcaggccctgtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctctggtgcctgacggtgagagcgacgacttggcggccactccagcgcaacccgaagaattacaggtacacaccgtcgtgccggaaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2225 - DNA, 438 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgc

SEQ ID NO: 2226 - DNA, 442 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctc

SEQ ID NO: 2227 - DNA, 433 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggcccc

SEQ ID NO: 2228 - DNA, 444 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctc

SEQ ID NO: 2229 - DNA, 438 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2230 - DNA, 443 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggct

SEQ ID NO: 2231 - DNA, 432 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggcccc

SEQ ID NO: 2232 - DNA, 429 bp, Artificial; identical to SEQ ID NO: 2191
  TaSBEIIa-B allele with mutations introduced by TALEN pair TaSBEIIa_T03

SEQ ID NO: 2233 - DNA, 431 bp, Artificial; identical to SEQ ID NO: 2201
  TaSBEIIa-B allele with mutations introduced by TALEN pair TaSBEIIa_T03

SEQ ID NO: 2234 - DNA, 428 bp, Artificial
  TaSBEIIa-B allele with mutations introduced by TALEN pair TaSBEIIa_T03
gagatagctggattaggcgatcgcctcaggcctgctgttatccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgagaattatcaggtacacaccgtcgtgccggaaaatcttcatgcaccgtattcacttaccaaatatcggatgaaccaagccgcggaggcatcaggtttcaagcttcttctatcagcattgtgcactacttcactgccttgtgcagtttgttagctgtgg

SEQ ID NO: 2235 - DNA, 448 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcgaggcgccgctcctgcagccgcgcggcctctccaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctc

SEQ ID NO: 2236 - DNA, 430 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2237 - DNA, 436 bp, Artificial; identical to SEQ ID NO: 2207
  TaSBEIIa-B allele with mutations introduced by TALEN pair TaSBEIIa_T03

SEQ ID NO: 2238 - DNA, 428 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctgg

SEQ ID NO: 2239 - DNA, 489 bp, Artificial
  TaSBEIIa-B allele with mutations introduced by TALEN pair TaSBEIIa_T03
  misc_feature (486): n is a or c or t or g
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaatcttcatgcacccgttattcacttaccaaaatatcggatgaaccaagccgcggaggcatcaggtttcaagcttcttctatcagcattgtgcactacttcactgccttgtgcagtttgttagctgtggcccncgc

SEQ ID NO: 2240 - DNA, 445 bp, Artificial; identical to SEQ ID NO: 2222
  TaSBEIIa-B allele with mutations introduced by TALEN pair TaSBEIIa_T03

SEQ ID NO: 2241 - DNA, 437 bp, Artificial; identical to SEQ ID NO: 2206
  TaSBEIIa-B allele with mutations introduced by TALEN pair TaSBEIIa_T03

SEQ ID NO: 2242 - DNA, 445 bp, Artificial; identical to SEQ ID NO: 2217
  TaSBEIIa-B allele with mutations introduced by TALEN pair TaSBEIIa_T03

SEQ ID NO: 2243 - DNA, 431 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttggcaaataagttgtagcattgtctcagtattgtactcatccttgcatttgcaggcgccgtcctgagccgcgcggcctctcgtgcctgacggtgagagcgacgacttggcggccactccagcgcaaccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctc

SEQ ID NO: 2244 - DNA, 445 bp, Artificial; identical to SEQ ID NO: 2222
  TaSBEIIa-B allele with mutations introduced by TALEN pair TaSBEIIa_T03

SEQ ID NO: 2245 - DNA, 439 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgccgc

SEQ ID NO: 2246 - DNA, 448 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgg

SEQ ID NO: 2247 - DNA, 451 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2248 - DNA, 466 bp, Artificial
  TaSBEIIa-B allele with mutations introduced by TALEN pair TaSBEIIa_T03
  misc_feature (39): n is a or c or t or g
gagatagctggattaggcgatcgcctcaggcctgtgttntccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaatcttcatgcacccgttattcacttaccaatcatcggatgaaccaagccgcggaggcatcaggtttcaagcttcttctatcagcattgtgcactacttcactgccttgtgcag

SEQ ID NO: 2249 - DNA, 442 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggc

SEQ ID NO: 2250 - DNA, 434 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggcccc

SEQ ID NO: 2251 - DNA, 445 bp, Artificial; identical to SEQ ID NO: 2217
  TaSBEIIa-B allele with mutations introduced by TALEN pair TaSBEIIa_T03

SEQ ID NO: 2252 - DNA, 435 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccg

SEQ ID NO: 2253 - DNA, 419 bp, Artificial
  TaSBEIIa-B allele with mutations introduced by TALEN pair TaSBEIIa_T03
gagatagctggattaggcgatcgcctcaggcctgctgttatccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctcgtgcctgacggtgagagcgacgacttggcggccactccagcgcaaccgcagaatatcaggtacacaccgtcgtgccggaaaatcttcatgcacccgtctattcacttaccaaatatcggatgaaccaagccgcggaggcatcaggtttcaagcttcttctatcagcattgtgcactacttcactgccttgtgcagtttgttagctgtgg

SEQ ID NO: 2254 - DNA, 448 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtggagacgcagcgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2255 - DNA, 445 bp, Artificial; identical to SEQ ID NO: 2217
  TaSBEIIa-B allele with mutations introduced by TALEN pair TaSBEIIa_T03

SEQ ID NO: 2256 - DNA, 446 bp, Artificial; identical to SEQ ID NO: 2194
  TaSBEIIa-B allele with mutations introduced by TALEN pair TaSBEIIa_T03

SEQ ID NO: 2257 - DNA, 451 bp, Artificial; identical to SEQ ID NO: 2247
  TaSBEIIa-B allele with mutations introduced by TALEN pair TaSBEIIa_T03

SEQ ID NO: 2258 - DNA, 445 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2259 - DNA, 440 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcgta

SEQ ID NO: 2260 - DNA, 438 bp, Artificial; identical to SEQ ID NO: 2225
  TaSBEIIa-B allele with mutations introduced by TALEN pair TaSBEIIa_T03

SEQ ID NO: 2261 - DNA, 435 bp, Artificial; identical to SEQ ID NO: 2252
  TaSBEIIa-B allele with mutations introduced by TALEN pair TaSBEIIa_T03

SEQ ID NO: 2262 - DNA, 424 bp, Artificial
  TaSBEIIa-B allele with mutations introduced by TALEN pair TaSBEIIa_T03
gagatagctggattaggcgatcgcctcaggccctgctgttatccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgagaattacaggtacacaccgtcgtgccggaaaatcttcatgcaccgttattcacttaccaaatatcggatgaaccaagccgcggaggcatcaggtttcaagcttcttctatcagcattgtgcactacttcactgccttgtgcagtttgttagc

SEQ ID NO: 2263 - DNA, 434 bp, Artificial
  TaSBEIIa-B allele with mutations introduced by TALEN pair TaSBEIIa_T03
gagatagctggattaggcgatcgcctcaggccctgtgttatccacggctctgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacactgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccg

SEQ ID NO: 2264 - DNA, 444 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2265 - DNA, 451 bp, Artificial; identical to SEQ ID NO: 2247
  TaSBEIIa-B allele with mutations introduced by TALEN pair TaSBEIIa_T03

SEQ ID NO: 2266 - DNA, 439 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2267 - DNA, 429 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2268 - DNA, 428 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccg

SEQ ID NO: 2269 - DNA, 440 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggc

SEQ ID NO: 2270 - DNA, 445 bp, Artificial; identical to SEQ ID NO: 2222
  TaSBEIIa-B allele with mutations introduced by TALEN pair TaSBEIIa_T03

SEQ ID NO: 2271 - DNA, 503 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagcgtttctgggtgagcaaaaacaggaaggcaaaatgccgcaaaaagggaaggtcctggtgcctgacggtgagagcgacgacttggcggccactccagcgcaacccgaagaattacaggtacacaccgtcgtgccggaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2272 - DNA, 446 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggttctt

SEQ ID NO: 2273 - DNA, 445 bp, Artificial; identical to SEQ ID NO: 2222
  TaSBEIIa-B allele with mutations introduced by TALEN pair TaSBEIIa_T03

SEQ ID NO: 2274 - DNA, 434 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggcccc

SEQ ID NO: 2275 - DNA, 452 bp, Artificial; identical to SEQ ID NO: 2202
  TaSBEIIa-B allele with mutations introduced by TALEN pair TaSBEIIa_T03

SEQ ID NO: 2276 - DNA, 432 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2277 - DNA, 510 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccatacaggggcaagcacctgggcggctccaggaagcccgacggcgccatctacaccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2278 - DNA, 452 bp, Artificial; identical to SEQ ID NO: 2202
  TaSBEIIa-B allele with mutations introduced by TALEN pair TaSBEIIa_T03

SEQ ID NO: 2279 - DNA, 492 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccagacagtaagagaattatgcagtgctgccataaccatgaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2280 - DNA, 439 bp, Artificial; identical to SEQ ID NO: 2266
  TaSBEIIa-B allele with mutations introduced by TALEN pair TaSBEIIa_T03

SEQ ID NO: 2281 - DNA, 444 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatatttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2282 - DNA, 508 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaatcttcatgcacccgttattcacttaccaaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2283 - DNA, 453 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2284 - DNA, 445 bp, Artificial; identical to SEQ ID NO: 2217
  TaSBEIIa-B allele with mutations introduced by TALEN pair TaSBEIIa_T03

SEQ ID NO: 2285 - DNA, 452 bp, Artificial; identical to SEQ ID NO: 2202
  TaSBEIIa-B allele with mutations introduced by TALEN pair TaSBEIIa_T03

SEQ ID NO: 2286 - DNA, 435 bp, Artificial; identical to SEQ ID NO: 2252
  TaSBEIIa-B allele with mutations introduced by TALEN pair TaSBEIIa_T03

SEQ ID NO: 2287 - DNA, 453 bp, Artificial; identical to SEQ ID NO: 2283
  TaSBEIIa-B allele with mutations introduced by TALEN pair TaSBEIIa_T03

SEQ ID NO: 2288 - DNA, 452 bp, Artificial; identical to SEQ ID NO: 2202
  TaSBEIIa-B allele with mutations introduced by TALEN pair TaSBEIIa_T03

SEQ ID NO: 2289 - DNA, 492 bp, Artificial; identical to SEQ ID NO: 2279
  TaSBEIIa-B allele with mutations introduced by TALEN pair TaSBEIIa_T03

SEQ ID NO: 2290 - DNA, 443 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctc

SEQ ID NO: 2291 - DNA, 424 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagc

SEQ ID NO: 2292 - DNA, 452 bp, Artificial; identical to SEQ ID NO: 2202
  TaSBEIIa-B allele with mutations introduced by TALEN pair TaSBEIIa_T03

SEQ ID NO: 2293 - DNA, 442 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctgg

SEQ ID NO: 2294 - DNA, 427 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctcctggtgcctgacggtgagagcgacgacttggcggccactccagcgcaacccgagaattacaggtacacaccgtcgtgccggaaaatcttcatgcacccgtttattcacttaccaaatatcggatgaaccaagccgcggaggcatcaggtttcaagcttcttctatcagcattgtgcactacttcactgccttgtgcagtttgttagctgtggccccg

SEQ ID NO: 2295 - DNA, 491 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccagacagtaagagaattatgcagtgctgccataaccatgaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggcccgcgctggctcttgggccactg

SEQ ID NO: 2296 - DNA, 445 bp, Artificial; identical to SEQ ID NO: 2217
  TaSBEIIa-B allele with mutations introduced by TALEN pair TaSBEIIa_T03

SEQ ID NO: 2297 - DNA, 452 bp, Artificial; identical to SEQ ID NO: 2202
  TaSBEIIa-B allele with mutations introduced by TALEN pair TaSBEIIa_T03

SEQ ID NO: 2298 - DNA, 445 bp, Artificial; identical to SEQ ID NO: 2222
  TaSBEIIa-B allele with mutations introduced by TALEN pair TaSBEIIa_T03

SEQ ID NO: 2299 - DNA, 444 bp, Artificial; identical to SEQ ID NO: 2228
  TaSBEIIa-B allele with mutations introduced by TALEN pair TaSBEIIa_T03

SEQ ID NO: 2300 - DNA, 445 bp, Artificial; identical to SEQ ID NO: 2217
  TaSBEIIa-B allele with mutations introduced by TALEN pair TaSBEIIa_T03

SEQ ID NO: 2301 - DNA, 439 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctg

SEQ ID NO: 2302 - DNA, 509 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccatacaggggcaagcacctgggcggctccaggaagcccgacggcgccatctacaccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2303 - DNA, 444 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggccttcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2304 - DNA, 452 bp, Artificial; identical to SEQ ID NO: 2202
  TaSBEIIa-B allele with mutations introduced by TALEN pair TaSBEIIa_T03

SEQ ID NO: 2305 - DNA, 452 bp, Artificial; identical to SEQ ID NO: 2202
  TaSBEIIa-B allele with mutations introduced by TALEN pair TaSBEIIa_T03

SEQ ID NO: 2306 - DNA, 453 bp, Artificial; identical to SEQ ID NO: 2283
  TaSBEIIa-B allele with mutations introduced by TALEN pair TaSBEIIa_T03

SEQ ID NO: 2307 - DNA, 434 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccg

SEQ ID NO: 2308 - DNA, 452 bp, Artificial; identical to SEQ ID NO: 2202
  TaSBEIIa-B allele with mutations introduced by TALEN pair TaSBEIIa_T03

SEQ ID NO: 2309 - DNA, 425 bp, Artificial
  TaSBEIIa-B allele with mutations introduced by TALEN pair TaSBEIIa_T03
gagatagctggattaggcgatcgcctcaggcctgtgttatccacggctttgatcatctcctcctttcatgctgatattttctcactctttcttctgttcttgctgtaactgcaagttgtagcatttttggcaaataagttgtagcattgtctcagtattgtactcatccttgcatttgcaggcgccgtcctgagccgcgcggcctctccctgacggtgagagcgacgacttggcggccactccagcgcaaccgaagaattacaggtacacaccgtcgtgccggaaatcttcatgcacccgttattcacttaccaaatatcggatgaaccaagccgcggaggcatcaggtttcaagcttcttctatcagcattgtgcactacttcactgccttgtgcagtttgttagctgtggccccgccgctggc

SEQ ID NO: 2310 - DNA, 493 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagacagtaagagaattatgcagtgctgccataaccatgaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2311 - DNA, 452 bp, Artificial; identical to SEQ ID NO: 2202
  TaSBEIIa-B allele with mutations introduced by TALEN pair TaSBEIIa_T03

SEQ ID NO: 2312 - DNA, 441 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagtgctgctcgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2313 - DNA, 430 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgc

SEQ ID NO: 2314 - DNA, 436 bp, Artificial; identical to SEQ ID NO: 2207
  TaSBEIIa-B allele with mutations introduced by TALEN pair TaSBEIIa_T03

SEQ ID NO: 2315 - DNA, 452 bp, Artificial; identical to SEQ ID NO: 2202
  TaSBEIIa-B allele with mutations introduced by TALEN pair TaSBEIIa_T03

SEQ ID NO: 2316 - DNA, 453 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2317 - DNA, 510 bp, Artificial; identical to SEQ ID NO: 2277
  TaSBEIIa-B allele with mutations introduced by TALEN pair TaSBEIIa_T03

SEQ ID NO: 2318 - DNA, 452 bp, Artificial; identical to SEQ ID NO: 2202
  TaSBEIIa-B allele with mutations introduced by TALEN pair TaSBEIIa_T03

SEQ ID NO: 2319 - DNA, 442 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcgtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2320 - DNA, 423 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgtttattcacttaccaaatatcggatgaaccaagccgcggaggcatcaggtttcaagcttcttctatcagcattgtgcactacttcactgccttgtgcagtttgttagctgtgg

SEQ ID NO: 2321 - DNA, 452 bp, Artificial; identical to SEQ ID NO: 2202
  TaSBEIIa-B allele with mutations introduced by TALEN pair TaSBEIIa_T03

SEQ ID NO: 2322 - DNA, 444 bp, Artificial; identical to SEQ ID NO: 2303
  TaSBEIIa-B allele with mutations introduced by TALEN pair TaSBEIIa_T03

SEQ ID NO: 2323 - DNA, 444 bp, Artificial; identical to SEQ ID NO: 2228
  TaSBEIIa-B allele with mutations introduced by TALEN pair TaSBEIIa_T03

SEQ ID NO: 2324 - DNA, 451 bp, Artificial; identical to SEQ ID NO: 2247
  TaSBEIIa-B allele with mutations introduced by TALEN pair TaSBEIIa_T03

SEQ ID NO: 2325 - DNA, 435 bp, Artificial; identical to SEQ ID NO: 2252
  TaSBEIIa-B allele with mutations introduced by TALEN pair TaSBEIIa_T03

SEQ ID NO: 2326 - DNA, 450 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagtgctggtcgctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2327 - DNA, 440 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgccgc

SEQ ID NO: 2328 - DNA, 424 bp, Artificial; identical to SEQ ID NO: 2291
  TaSBEIIa-B allele with mutations introduced by TALEN pair TaSBEIIa_T03

SEQ ID NO: 2329 - DNA, 431 bp, Artificial; identical to SEQ ID NO: 2201
  TaSBEIIa-B allele with mutations introduced by TALEN pair TaSBEIIa_T03

SEQ ID NO: 2330 - DNA, 503 bp, Artificial; identical to SEQ ID NO: 2271
  TaSBEIIa-B allele with mutations introduced by TALEN pair TaSBEIIa_T03

SEQ ID NO: 2331 - DNA, 434 bp, Artificial
  TaSBEIIa-B allele with mutations introduced by TALEN pair TaSBEIIa_T03
gagatagctggattaggcgatcgcctcaggccctgtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccg

SEQ ID NO: 2332 - DNA, 445 bp, Artificial; identical to SEQ ID NO: 2217
  TaSBEIIa-B allele with mutations introduced by TALEN pair TaSBEIIa_T03

SEQ ID NO: 2333 - DNA, 438 bp, Artificial; identical to SEQ ID NO: 2225
  TaSBEIIa-B allele with mutations introduced by TALEN pair TaSBEIIa_T03

SEQ ID NO: 2334 - DNA, 439 bp, Artificial; identical to SEQ ID NO: 2266
  TaSBEIIa-B allele with mutations introduced by TALEN pair TaSBEIIa_T03

SEQ ID NO: 2335 - DNA, 453 bp, Artificial; identical to SEQ ID NO: 2283
  TaSBEIIa-B allele with mutations introduced by TALEN pair TaSBEIIa_T03

SEQ ID NO: 2336 - DNA, 445 bp, Artificial; identical to SEQ ID NO: 2217
  TaSBEIIa-B allele with mutations introduced by TALEN pair TaSBEIIa_T03

SEQ ID NO: 2337 - DNA, 452 bp, Artificial; identical to SEQ ID NO: 2202
  TaSBEIIa-B allele with mutations introduced by TALEN pair TaSBEIIa_T03

SEQ ID NO: 2338 - DNA, 452 bp, Artificial; identical to SEQ ID NO: 2202
  TaSBEIIa-B allele with mutations introduced by TALEN pair TaSBEIIa_T03

SEQ ID NO: 2339 - DNA, 434 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcgtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctc

SEQ ID NO: 2340 - DNA, 436 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctc

SEQ ID NO: 2341 - DNA, 446 bp, Artificial; identical to SEQ ID NO: 2194
  TaSBEIIa-B allele with mutations introduced by TALEN pair TaSBEIIa_T03

SEQ ID NO: 2342 - DNA, 452 bp, Artificial; identical to SEQ ID NO: 2202
  TaSBEIIa-B allele with mutations introduced by TALEN pair TaSBEIIa_T03

SEQ ID NO: 2343 - DNA, 452 bp, Artificial; identical to SEQ ID NO: 2202
  TaSBEIIa-B allele with mutations introduced by TALEN pair TaSBEIIa_T03

SEQ ID NO: 2344 - DNA, 419 bp, Artificial
  TaSBEIIa-B allele with mutations introduced by TALEN pair TaSBEIIa_T03
gagatagctggattaggcgatcgcctcaggcctgctggttgatccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggccttcctggtgcctgacggtgagagcgacgacttggcggccactccagcgcaaccgcagaatatcaggtacacaccgtcgtgccggaaaatcttcatgcaccgtctattcacttaccaaatatcggatgaaccaagccgcggaggcatcaggttttcaagcttcttctatcagcattgtgcactacttcactgccttgtgcagtttgttagcg

SEQ ID NO: 2345 - DNA, 451 bp, Artificial; identical to SEQ ID NO: 2247
  TaSBEIIa-B allele with mutations introduced by TALEN pair TaSBEIIa_T03

SEQ ID NO: 2346 - DNA, 446 bp, Artificial; identical to SEQ ID NO: 2194
  TaSBEIIa-B allele with mutations introduced by TALEN pair TaSBEIIa_T03

SEQ ID NO: 2347 - DNA, 429 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatatttttctcactctttcttctgttcttgctgtaactgcaagttgtagcatttttttggcaaataagttgtagcattgtctcagtattgtactcatccttgcatttgcaggcgccgtcctgagccgcgcggcctctcgtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgc

SEQ ID NO: 2348 - DNA, 466 bp, Artificial
  TaSBEIIa-B allele with mutations introduced by TALEN pair TaSBEIIa_T03
gagatagctggattaggcgatcgcctcaggcctgctggttatccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccagcgtttctgggtgagcaaaacaggaaggcaaatgccgcaaaaagggaaggtcctggtgcctgacggtgagagcgacgacttggcggccactccagcgcaaccccgaagaattacaggtacacaccgtcgtgccggaaatcttcatgcaccgttattcacttaccaaatatcggatgaaccaagccgcggaggcatcaggtttcaagcttcttctatcagcattgtgcactacttcactgccttgtgcagtttg

SEQ ID NO: 2349 - DNA, 488 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagcgtttctgggtgagcaaaaacaggaaggcaaatgccgcaaaaagggaaggtcctggtgcctgacggtgagagcgacgatcttggcggccactccagcgcaacccgaagaattacaggtacacaccgtcgatgccggaaatcttcatgcacccgttattcacttaccaaatatcggatgaaccaagccgcggaggcatcaggtttcaagcttcttctatcagcattgtgcactacttcactgccttgtgcagtttgttagctgtggccccgcgct

SEQ ID NO: 2350 - DNA, 433 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccg

SEQ ID NO: 2351 - DNA, 424 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgc

SEQ ID NO: 2352 - DNA, 443 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctc

SEQ ID NO: 2353 - DNA, 426 bp, Artificial
  TaSBEIIa-B allele with mutations introduced by TALEN pair TaSBEIIa_T03
  misc_feature (40): n is a or c or t or g
gagatagctggattaggcgatcgcctcaggcctgctgttntccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgtattcacttaccaaatatcggatgaaccaagccgcggaggcatcaggtttcaagcttcttctatcagcattgtgcactacttcactgccttgtgcagtttgttagcgt

SEQ ID NO: 2354 - DNA, 446 bp, Artificial; identical to SEQ ID NO: 2194
  TaSBEIIa-B allele with mutations introduced by TALEN pair TaSBEIIa_T03

SEQ ID NO: 2355 - DNA, 445 bp, Artificial; identical to SEQ ID NO: 2217
  TaSBEIIa-B allele with mutations introduced by TALEN pair TaSBEIIa_T03

SEQ ID NO: 2356 - DNA, 452 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtatgcattttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2357 - DNA, 451 bp, Artificial; identical to SEQ ID NO: 2247
  TaSBEIIa-B allele with mutations introduced by TALEN pair TaSBEIIa_T03

SEQ ID NO: 2358 - DNA, 437 bp, Artificial; identical to SEQ ID NO: 2206
  TaSBEIIa-B allele with mutations introduced by TALEN pair TaSBEIIa_T03

SEQ ID NO: 2359 - DNA, 441 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctgg

SEQ ID NO: 2360 - DNA, 451 bp, Artificial; identical to SEQ ID NO: 2247
  TaSBEIIa-B allele with mutations introduced by TALEN pair TaSBEIIa_T03

SEQ ID NO: 2361 - DNA, 452 bp, Artificial; identical to SEQ ID NO: 2202
  TaSBEIIa-B allele with mutations introduced by TALEN pair TaSBEIIa_T03

SEQ ID NO: 2362 - DNA, 452 bp, Artificial; identical to SEQ ID NO: 2202
  TaSBEIIa-B allele with mutations introduced by TALEN pair TaSBEIIa_T03

SEQ ID NO: 2363 - DNA, 452 bp, Artificial; identical to SEQ ID NO: 2202
  TaSBEIIa-B allele with mutations introduced by TALEN pair TaSBEIIa_T03

SEQ ID NO: 2364 - DNA, 428 bp, Artificial
  TaSBEIIa-B allele with mutations introduced by TALEN pair TaSBEIIa_T03
  misc_feature (166): n is a or c or t or g
gagatagctggattaggcgatcgcctcaggccctggtgttaccacggctttgatcatctcctccttttcatgctgatatttttctcactctttcttctgttcttgctgtaactgcaagttgtagcatttttttggcaaataagttgtagcattgtctcagtattgnactcatccttgcatttgcaggcgccgtcctgagccgcgcggcctctcctggtgcctgacggtgagagcgacgacttggcggccactccagcgcaacccgagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggcccc

SEQ ID NO: 2365 - DNA, 505 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagcgtttctgggtgagcaaaaacaggaaggcaaaatgccgcaaaaaagggaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2366 - DNA, 513 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccagggcgagcggtatcagctcactcaaaggcggtaatacggttatccacagaatcagggaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2367 - DNA, 430 bp, Artificial; identical to SEQ ID NO: 2313
  TaSBEIIa-B allele with mutations introduced by TALEN pair TaSBEIIa_T03

SEQ ID NO: 2368 - DNA, 456 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaaccaagccgcggaggcgtcaggttttgagcttcttctatcagcattgtgcagtactgcactgccttgtgcattttgttagccgtggccccgtgctggctcttgggccactg

SEQ ID NO: 2369 - DNA, 452 bp, Artificial; identical to SEQ ID NO: 2202
  TaSBEIIa-B allele with mutations introduced by TALEN pair TaSBEIIa_T03

SEQ ID NO: 2370 - DNA, 435 bp, Artificial
  TaSBEIIa-B allele with mutations introduced by TALEN pair TaSBEIIa_T03
gagatagctggattaggcgatcgcctcaggccctggtgttaccacggctttgatcatcctccttcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcgtt

SEQ ID NO: 2371 - DNA, 452 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgcagtaactgcaagttgtagcattttttggcaaataagttgtagcattgtctcagtattgtactcatccttgcatttgcaggcgccgtcctgagccgcgcggcctctccaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2372 - DNA, 502 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagcgtttctgggtgagcaaaacaggaaggcaaaatgccgcaaaaagggaaggtcctggtgcctgacggtgagagcgacgacttggcggccactccagcgcaacccgaagaattacaggtacacaccgtcgtgccggaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2373 - DNA, 452 bp, Artificial; identical to SEQ ID NO: 2202
  TaSBEIIa-B allele with mutations introduced by TALEN pair TaSBEIIa_T03

SEQ ID NO: 2374 - DNA, 489 bp, Artificial
  TaSBEIIa-B allele with mutations introduced by TALEN pair TaSBEIIa_T03
gagatagctggattaggcgatcgcctcaggcccctggtgttaccacggctttgatcatctccctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagcgtttctgggtgagcaaaaacaggaaggcaaaatgccgcaaaaagggaaggtcctggtgcctgacggtgagagcgacgacttggcggccactccagcgcaacccgaagaattacaggtacacaccgtcgtgccggaaatcttcatgcacccgttattcacttaccaaatatcggatgaaccaagccgcggaggcatcaggtttcaagcttcttctatcagcattgtgcactacttcactgccttgtgcagtttgttagctgtggccccgcgct

SEQ ID NO: 2375 - DNA, 445 bp, Artificial; identical to SEQ ID NO: 2217
  TaSBEIIa-B allele with mutations introduced by TALEN pair TaSBEIIa_T03

SEQ ID NO: 2376 - DNA, 446 bp, Artificial; identical to SEQ ID NO: 2194
  TaSBEIIa-B allele with mutations introduced by TALEN pair TaSBEIIa_T03

SEQ ID NO: 2377 - DNA, 452 bp, Artificial; identical to SEQ ID NO: 2202
  TaSBEIIa-B allele with mutations introduced by TALEN pair TaSBEIIa_T03

SEQ ID NO: 2378 - DNA, 452 bp, Artificial; identical to SEQ ID NO: 2202
  TaSBEIIa-B allele with mutations introduced by TALEN pair TaSBEIIa_T03

SEQ ID NO: 2379 - DNA, 515 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagggcgagcggtatcagctcactcaaaggcggtaatacggttatccacagaatcaggggaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2380 - DNA, 451 bp, Artificial; identical to SEQ ID NO: 2247
  TaSBEIIa-B allele with mutations introduced by TALEN pair TaSBEIIa_T03

SEQ ID NO: 2381 - DNA, 510 bp, Artificial; identical to SEQ ID NO: 2277
  TaSBEIIa-B allele with mutations introduced by TALEN pair TaSBEIIa_T03

SEQ ID NO: 2382 - DNA, 452 bp, Artificial; identical to SEQ ID NO: 2202
  TaSBEIIa-B allele with mutations introduced by TALEN pair TaSBEIIa_T03

SEQ ID NO: 2383 - DNA, 431 bp, Artificial
  TaSBEIIa-B allele with mutations introduced by TALEN pair TaSBEIIa_T03
gagatagctggattaggcgatcgccccaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgc

SEQ ID NO: 2384 - DNA, 444 bp, Artificial; identical to SEQ ID NO: 2264
  TaSBEIIa-B allele with mutations introduced by TALEN pair TaSBEIIa_T03

SEQ ID NO: 2385 - DNA, 452 bp, Artificial; identical to SEQ ID NO: 2202
  TaSBEIIa-B allele with mutations introduced by TALEN pair TaSBEIIa_T03

SEQ ID NO: 2386 - DNA, 427 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggcccc

SEQ ID NO: 2387 - DNA, 451 bp, Artificial; identical to SEQ ID NO: 2247
  TaSBEIIa-B allele with mutations introduced by TALEN pair TaSBEIIa_T03

SEQ ID NO: 2388 - DNA, 444 bp, Artificial; identical to SEQ ID NO: 2264
  TaSBEIIa-B allele with mutations introduced by TALEN pair TaSBEIIa_T03

SEQ ID NO: 2389 - DNA, 425 bp, Artificial
  TaSBEIIa-B allele with mutations introduced by TALEN pair TaSBEIIa_T03
gagatagctggattaggcgatcgcctcaggccctgtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaaaggtcctggtgcctgacggtgagagcgacgacttggcggccactccagcgcaacccgagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagc

SEQ ID NO: 2390 - DNA, 445 bp, Artificial; identical to SEQ ID NO: 2217
  TaSBEIIa-B allele with mutations introduced by TALEN pair TaSBEIIa_T03

SEQ ID NO: 2391 - DNA, 438 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2392 - DNA, 446 bp, Artificial; identical to SEQ ID NO: 2194
  TaSBEIIa-B allele with mutations introduced by TALEN pair TaSBEIIa_T03

SEQ ID NO: 2393 - DNA, 445 bp, Artificial; identical to SEQ ID NO: 2217
  TaSBEIIa-B allele with mutations introduced by TALEN pair TaSBEIIa_T03

SEQ ID NO: 2394 - DNA, 435 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggccttcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctc

SEQ ID NO: 2395 - DNA, 514 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagggcgagcggtatcagctcactcaaaggcggtaatacggttatccacagaatcagggaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2396 - DNA, 444 bp, Artificial; identical to SEQ ID NO: 2303
  TaSBEIIa-B allele with mutations introduced by TALEN pair TaSBEIIa_T03

SEQ ID NO: 2397 - DNA, 425 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgc

SEQ ID NO: 2398 - DNA, 443 bp, Artificial; identical to SEQ ID NO: 2352
  TaSBEIIa-B allele with mutations introduced by TALEN pair TaSBEIIa_T03

SEQ ID NO: 2399 - DNA, 438 bp, Artificial; identical to SEQ ID NO: 2225
  TaSBEIIa-B allele with mutations introduced by TALEN pair TaSBEIIa_T03

SEQ ID NO: 2400 - DNA, 439 bp, Artificial; identical to SEQ ID NO: 2266
  TaSBEIIa-B allele with mutations introduced by TALEN pair TaSBEIIa_T03

SEQ ID NO: 2401 - DNA, 446 bp, Artificial; identical to SEQ ID NO: 2194
  TaSBEIIa-B allele with mutations introduced by TALEN pair TaSBEIIa_T03

SEQ ID NO: 2402 - DNA, 427 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagct

SEQ ID NO: 2403 - DNA, 439 bp, Artificial; identical to SEQ ID NO: 2266
  TaSBEIIa-B allele with mutations introduced by TALEN pair TaSBEIIa_T03

SEQ ID NO: 2404 - DNA, 436 bp, Artificial; identical to SEQ ID NO: 2340
  TaSBEIIa-B allele with mutations introduced by TALEN pair TaSBEIIa_T03

SEQ ID NO: 2405 - DNA, 504 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagcgtttctgggtgagcaaaaacaggaaggcaaaatgccgcaaaaaagggaaggtcctggtgcctgacggtgagagcgacgacttggcggccactccagcgcaacccgaagaattacaggtacacaccgtcgtgccggaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2406 - DNA, 444 bp, Artificial; identical to SEQ ID NO: 2303
  TaSBEIIa-B allele with mutations introduced by TALEN pair TaSBEIIa_T03

SEQ ID NO: 2407 - DNA, 444 bp, Artificial; identical to SEQ ID NO: 2264
  TaSBEIIa-B allele with mutations introduced by TALEN pair TaSBEIIa_T03

SEQ ID NO: 2408 - DNA, 452 bp, Artificial; identical to SEQ ID NO: 2202
  TaSBEIIa-B allele with mutations introduced by TALEN pair TaSBEIIa_T03

SEQ ID NO: 2409 - DNA, 453 bp, Artificial; identical to SEQ ID NO: 2283
  TaSBEIIa-B allele with mutations introduced by TALEN pair TaSBEIIa_T03

SEQ ID NO: 2410 - DNA, 452 bp, Artificial; identical to SEQ ID NO: 2202
  TaSBEIIa-B allele with mutations introduced by TALEN pair TaSBEIIa_T03

SEQ ID NO: 2411 - DNA, 452 bp, Artificial; identical to SEQ ID NO: 2202
  TaSBEIIa-B allele with mutations introduced by TALEN pair TaSBEIIa_T03

SEQ ID NO: 2412 - DNA, 514 bp, Artificial; identical to SEQ ID NO: 2395
  TaSBEIIa-B allele with mutations introduced by TALEN pair TaSBEIIa_T03

SEQ ID NO: 2413 - DNA, 452 bp, Artificial; identical to SEQ ID NO: 2202
  TaSBEIIa-B allele with mutations introduced by TALEN pair TaSBEIIa_T03

SEQ ID NO: 2414 - DNA, 446 bp, Artificial; identical to SEQ ID NO: 2194
  TaSBEIIa-B allele with mutations introduced by TALEN pair TaSBEIIa_T03

SEQ ID NO: 2415 - DNA, 434 bp, Artificial; identical to SEQ ID NO: 2339
  TaSBEIIa-B allele with mutations introduced by TALEN pair TaSBEIIa_T03

SEQ ID NO: 2416 - DNA, 425 bp, Artificial; identical to SEQ ID NO: 2397
  TaSBEIIa-B allele with mutations introduced by TALEN pair TaSBEIIa_T03

SEQ ID NO: 2417 - DNA, 451 bp, Artificial; identical to SEQ ID NO: 2247
  TaSBEIIa-B allele with mutations introduced by TALEN pair TaSBEIIa_T03

SEQ ID NO: 2418 - DNA, 445 bp, Artificial; identical to SEQ ID NO: 2217
  TaSBEIIa-B allele with mutations introduced by TALEN pair TaSBEIIa_T03

SEQ ID NO: 2419 - DNA, 451 bp, Artificial; identical to SEQ ID NO: 2247
  TaSBEIIa-B allele with mutations introduced by TALEN pair TaSBEIIa_T03

SEQ ID NO: 2420 - DNA, 433 bp, Artificial
  TaSBEIIa-B allele with mutations introduced by TALEN pair TaSBEIIa_T03
  misc_feature (166): n is a or c or t or g
gagatagctggattaggcgatcgcctcaggccctggtgttaccacggctttgatcatctcctcctttcatgctgatatttttctcactcttttcttctgttcttgctgtaactgcaagttgtagcatttttttggcaaataagttgtagcattgtctcagtattgnactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgc

SEQ ID NO: 2421 - DNA, 444 bp, Artificial; identical to SEQ ID NO: 2264
  TaSBEIIa-B allele with mutations introduced by TALEN pair TaSBEIIa_T03

SEQ ID NO: 2422 - DNA, 444 bp, Artificial
  TaSBEIIa-B allele with mutations introduced by TALEN pair TaSBEIIa_T03
gagatagctggattaggcgatcgcctcaggcccctggtgttaccacggcttttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcgtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcaa

SEQ ID NO: 2423 - DNA, 451 bp, Artificial; identical to SEQ ID NO: 2247
  TaSBEIIa-B allele with mutations introduced by TALEN pair TaSBEIIa_T03

SEQ ID NO: 2424 - DNA, 452 bp, Artificial; identical to SEQ ID NO: 2202
  TaSBEIIa-B allele with mutations introduced by TALEN pair TaSBEIIa_T03

SEQ ID NO: 2425 - DNA, 446 bp, Artificial; identical to SEQ ID NO: 2194
  TaSBEIIa-B allele with mutations introduced by TALEN pair TaSBEIIa_T03

SEQ ID NO: 2426 - DNA, 452 bp, Artificial; identical to SEQ ID NO: 2202
  TaSBEIIa-B allele with mutations introduced by TALEN pair TaSBEIIa_T03

SEQ ID NO: 2427 - DNA, 421 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccg

SEQ ID NO: 2428 - DNA, 445 bp, Artificial; identical to SEQ ID NO: 2217
  TaSBEIIa-B allele with mutations introduced by TALEN pair TaSBEIIa_T03

SEQ ID NO: 2429 - DNA, 438 bp, Artificial; identical to SEQ ID NO: 2225
  TaSBEIIa-B allele with mutations introduced by TALEN pair TaSBEIIa_T03

SEQ ID NO: 2430 - DNA, 507 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccatacaggggcaagcacctgggcggctccaggaagcccgacggcgccatctacaccaaggtcctggtgcctgacggtgagagcgacgacttggcggccactccagcgcaacccgaagaattacaggtacacaccgtcgtgccggaaatcttcatgcacccgttattcacttaccaaatatcggatgaaccaagccgcggaggcatcaggtttcaagcttcttctatcagcattgtgcactacttcactgccttgtgcagtttgttagctgtggcccgcgctggctcttgggccactg

SEQ ID NO: 2431 - DNA, 444 bp, Artificial; identical to SEQ ID NO: 2228
  TaSBEIIa-B allele with mutations introduced by TALEN pair TaSBEIIa_T03

SEQ ID NO: 2432 - DNA, 445 bp, Artificial; identical to SEQ ID NO: 2217
  TaSBEIIa-B allele with mutations introduced by TALEN pair TaSBEIIa_T03

SEQ ID NO: 2433 - DNA, 452 bp, Artificial; identical to SEQ ID NO: 2202
  TaSBEIIa-B allele with mutations introduced by TALEN pair TaSBEIIa_T03

SEQ ID NO: 2434 - DNA, 437 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctc

SEQ ID NO: 2435 - DNA, 511 bp, Artificial
  TaSBEIIa-B allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcattttttggcaaataagttgtagcattgtctcagtattgtactcatccttgcatttgcaggcgccgtcctgagccgcgcggcctctccagcgtttctgggtgagcaaaaacaggaaggcaaatgccgcaaaaagggaagtcctggtgcctgacggtgagagcgacgacttggcggccactccagcgcaacccgaagaattacaggtacacaccgtcgtgccggaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2436 - DNA, 452 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctcctcaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2437 - DNA, 452 bp, Artificial; identical to SEQ ID NO: 2202
  TaSBEIIa-B allele with mutations introduced by TALEN pair TaSBEIIa_T03

SEQ ID NO: 2438 - DNA, 453 bp, Artificial; identical to SEQ ID NO: 2283
  TaSBEIIa-B allele with mutations introduced by TALEN pair TaSBEIIa_T03

SEQ ID NO: 2439 - DNA, 445 bp, Artificial; identical to SEQ ID NO: 2217
  TaSBEIIa-B allele with mutations introduced by TALEN pair TaSBEIIa_T03

SEQ ID NO: 2440 - DNA, 445 bp, Artificial; identical to SEQ ID NO: 2258
  TaSBEIIa-B allele with mutations introduced by TALEN pair TaSBEIIa_T03

SEQ ID NO: 2441 - DNA, 441 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagcgtggccccgcgctggc

SEQ ID NO: 2442 - DNA, 445 bp, Artificial; identical to SEQ ID NO: 2217
  TaSBEIIa-B allele with mutations introduced by TALEN pair TaSBEIIa_T03

SEQ ID NO: 2443 - DNA, 446 bp, Artificial; identical to SEQ ID NO: 2194
  TaSBEIIa-B allele with mutations introduced by TALEN pair TaSBEIIa_T03

SEQ ID NO: 2444 - DNA, 430 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2445 - DNA, 435 bp, Artificial; identical to SEQ ID NO: 2199
  TaSBEIIa-B allele with mutations introduced by TALEN pair TaSBEIIa_T03

SEQ ID NO: 2446 - DNA, 445 bp, Artificial; identical to SEQ ID NO: 2258
  TaSBEIIa-B allele with mutations introduced by TALEN pair TaSBEIIa_T03

SEQ ID NO: 2447 - DNA, 415 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccctgacggtgagagcgacgacttggcggccactccagcgcaaccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2448 - DNA, 452 bp, Artificial; identical to SEQ ID NO: 2202
  TaSBEIIa-B allele with mutations introduced by TALEN pair TaSBEIIa_T03

SEQ ID NO: 2449 - DNA, 451 bp, Artificial; identical to SEQ ID NO: 2247
  TaSBEIIa-B allele with mutations introduced by TALEN pair TaSBEIIa_T03

SEQ ID NO: 2450 - DNA, 436 bp, Artificial; identical to SEQ ID NO: 2207
  TaSBEIIa-B allele with mutations introduced by TALEN pair TaSBEIIa_T03

SEQ ID NO: 2451 - DNA, 505 bp, Artificial; identical to SEQ ID NO: 2365
  TaSBEIIa-B allele with mutations introduced by TALEN pair TaSBEIIa_T03

SEQ ID NO: 2452 - DNA, 451 bp, Artificial; identical to SEQ ID NO: 2247
  TaSBEIIa-B allele with mutations introduced by TALEN pair TaSBEIIa_T03

SEQ ID NO: 2453 - DNA, 452 bp, Artificial; identical to SEQ ID NO: 2202
  TaSBEIIa-B allele with mutations introduced by TALEN pair TaSBEIIa_T03

SEQ ID NO: 2454 - DNA, 452 bp, Artificial; identical to SEQ ID NO: 2202
  TaSBEIIa-B allele with mutations introduced by TALEN pair TaSBEIIa_T03

SEQ ID NO: 2455 - DNA, 430 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2456 - DNA, 508 bp, Artificial; identical to SEQ ID NO: 2282
  TaSBEIIa-B allele with mutations introduced by TALEN pair TaSBEIIa_T03

SEQ ID NO: 2457 - DNA, 428 bp, Artificial
  TaSBEIIa-B allele with mutations introduced by TALEN pair TaSBEIIa_T03
  misc_feature (163): n is a or c or t or g
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgnactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2458 - DNA, 453 bp, Artificial; identical to SEQ ID NO: 2283
  TaSBEIIa-B allele with mutations introduced by TALEN pair TaSBEIIa_T03

SEQ ID NO: 2459 - DNA, 436 bp, Artificial; identical to SEQ ID NO: 2340
  TaSBEIIa-B allele with mutations introduced by TALEN pair TaSBEIIa_T03

SEQ ID NO: 2460 - DNA, 452 bp, Artificial
  TaSBEIIa-B allele with mutations introduced by TALEN pair TaSBEIIa_T03
  misc_feature (164): n is a or c or t or g
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgnactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2461 - DNA, 416 bp, Artificial; identical to SEQ ID NO: 2216
  TaSBEIIa-B allele with mutations introduced by TALEN pair TaSBEIIa_T03

SEQ ID NO: 2462 - DNA, 432 bp, Artificial
  TaSBEIIa-B allele with mutations introduced by TALEN pair TaSBEIIa_T03
gagatagctggattaggcgatcgcctcaggccctgtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccg

SEQ ID NO: 2463 - DNA, 447 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2464 - DNA, 434 bp, Artificial; identical to SEQ ID NO: 2339
  TaSBEIIa-B allele with mutations introduced by TALEN pair TaSBEIIa_T03

SEQ ID NO: 2465 - DNA, 445 bp, Artificial; identical to SEQ ID NO: 2217
  TaSBEIIa-B allele with mutations introduced by TALEN pair TaSBEIIa_T03

SEQ ID NO: 2466 - DNA, 510 bp, Artificial; identical to SEQ ID NO: 2277
  TaSBEIIa-B allele with mutations introduced by TALEN pair TaSBEIIa_T03

SEQ ID NO: 2467 - DNA, 433 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2468 - DNA, 452 bp, Artificial; identical to SEQ ID NO: 2202
  TaSBEIIa-B allele with mutations introduced by TALEN pair TaSBEIIa_T03

SEQ ID NO: 2469 - DNA, 492 bp, Artificial; identical to SEQ ID NO: 2279
  TaSBEIIa-B allele with mutations introduced by TALEN pair TaSBEIIa_T03

SEQ ID NO: 2470 - DNA, 443 bp, Artificial; identical to SEQ ID NO: 2352
  TaSBEIIa-B allele with mutations introduced by TALEN pair TaSBEIIa_T03

SEQ ID NO: 2471 - DNA, 492 bp, Artificial; identical to SEQ ID NO: 2279
  TaSBEIIa-B allele with mutations introduced by TALEN pair TaSBEIIa_T03

SEQ ID NO: 2472 - DNA, 515 bp, Artificial; identical to SEQ ID NO: 2379
  TaSBEIIa-B allele with mutations introduced by TALEN pair TaSBEIIa_T03

SEQ ID NO: 2473 - DNA, 452 bp, Artificial; identical to SEQ ID NO: 2202
  TaSBEIIa-B allele with mutations introduced by TALEN pair TaSBEIIa_T03

SEQ ID NO: 2474 - DNA, 433 bp, Artificial; identical to SEQ ID NO: 2467
  TaSBEIIa-B allele with mutations introduced by TALEN pair TaSBEIIa_T03

SEQ ID NO: 2475 - DNA, 510 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccatacaggggcaagcacctgggcggctccaggaagcccgacggcgccatctacaccaaggtcctggtgcctgacggtgagagcgacgacttggcggccactccagcgcaacccgaagaattacaggtacacaccgtcgtgccggaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactgaa

SEQ ID NO: 2476 - DNA, 438 bp, Artificial; identical to SEQ ID NO: 2225
  TaSBEIIa-B allele with mutations introduced by TALEN pair TaSBEIIa_T03

SEQ ID NO: 2477 - DNA, 451 bp, Artificial; identical to SEQ ID NO: 2247
  TaSBEIIa-B allele with mutations introduced by TALEN pair TaSBEIIa_T03

SEQ ID NO: 2478 - DNA, 453 bp, Artificial; identical to SEQ ID NO: 2283
  TaSBEIIa-B allele with mutations introduced by TALEN pair TaSBEIIa_T03

SEQ ID NO: 2479 - DNA, 439 bp, Artificial; identical to SEQ ID NO: 2266
  TaSBEIIa-B allele with mutations introduced by TALEN pair TaSBEIIa_T03

SEQ ID NO: 2480 - DNA, 451 bp, Artificial; identical to SEQ ID NO: 2247
  TaSBEIIa-B allele with mutations introduced by TALEN pair TaSBEIIa_T03

SEQ ID NO: 2481 - DNA, 451 bp, Artificial; identical to SEQ ID NO: 2247
  TaSBEIIa-B allele with mutations introduced by TALEN pair TaSBEIIa_T03

SEQ ID NO: 2482 - DNA, 452 bp, Artificial; identical to SEQ ID NO: 2202
  TaSBEIIa-B allele with mutations introduced by TALEN pair TaSBEIIa_T03

SEQ ID NO: 2483 - DNA, 430 bp, Artificial
  TaSBEIIa-B allele with mutations introduced by TALEN pair TaSBEIIa_T03
  misc_feature (164): n is a or c or t or g
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgnactcatccttgcatttgcaggcgccgtcctgagccgcgcggcctctctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgc

SEQ ID NO: 2484 - DNA, 445 bp, Artificial; identical to SEQ ID NO: 2217
  TaSBEIIa-B allele with mutations introduced by TALEN pair TaSBEIIa_T03

SEQ ID NO: 2485 - DNA, 452 bp, Artificial; identical to SEQ ID NO: 2202
  TaSBEIIa-B allele with mutations introduced by TALEN pair TaSBEIIa_T03

SEQ ID NO: 2486 - DNA, 452 bp, Artificial; identical to SEQ ID NO: 2202
  TaSBEIIa-B allele with mutations introduced by TALEN pair TaSBEIIa_T03

SEQ ID NO: 2487 - DNA, 439 bp, Artificial; identical to SEQ ID NO: 2266
  TaSBEIIa-B allele with mutations introduced by TALEN pair TaSBEIIa_T03

SEQ ID NO: 2488 - DNA, 495 bp, Artificial
  TaSBEIIa-B allele with mutations introduced by TALEN pair TaSBEIIa_T03
  misc_feature (345): n is a or c or t or g
gagatagctggattaggcgatcgcctcaggccctggtgttatccacggctttgatcatctcctcctttcatgctgatatttctcactctttcttctgttcttgctgtaatctgcaagttgtagtcattttttggcaaataagttgtagcattgtctcagtattgttactcatccttgcatttgcaggcgccgtcctgagccgcgcggcctctccagacagtaagagaattatgcagtgctgccataccatgaagtcctggtgcctgacggtgagagcgacgacttggcggccactccagcgcaacccgaagaattacaggtacacaccgtcgtgccggaaaaatnttcatgcacccgttattcacttaccaaatatcggatgaccaagccgcggaggcatcaggttccaagcttcttctatcagcattgtgcactagcttcactgccttgtggcagtttgttagctgtggccccgcgctggctcttgggccactg

SEQ ID NO: 2489 - DNA, 451 bp, Artificial; identical to SEQ ID NO: 2247
  TaSBEIIa-B allele with mutations introduced by TALEN pair TaSBEIIa_T03

SEQ ID NO: 2490 - DNA, 452 bp, Artificial; identical to SEQ ID NO: 2202
  TaSBEIIa-B allele with mutations introduced by TALEN pair TaSBEIIa_T03

SEQ ID NO: 2491 - DNA, 453 bp, Artificial; identical to SEQ ID NO: 2283
  TaSBEIIa-B allele with mutations introduced by TALEN pair TaSBEIIa_T03

SEQ ID NO: 2492 - DNA, 452 bp, Artificial; identical to SEQ ID NO: 2202
  TaSBEIIa-B allele with mutations introduced by TALEN pair TaSBEIIa_T03

SEQ ID NO: 2493 - DNA, 446 bp, Artificial; identical to SEQ ID NO: 2194
  TaSBEIIa-B allele with mutations introduced by TALEN pair TaSBEIIa_T03

SEQ ID NO: 2494 - DNA, 425 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgtttattcacttaccaaatatcggatgaaccaagccgcggaggcatcaggtttcaagcttcttctatcagcattgtgcactacttcactgccttgtgcagtttgttagctgtgg

SEQ ID NO: 2495 - DNA, 451 bp, Artificial; identical to SEQ ID NO: 2247
  TaSBEIIa-B allele with mutations introduced by TALEN pair TaSBEIIa_T03

SEQ ID NO: 2496 - DNA, 452 bp, Artificial; identical to SEQ ID NO: 2202
  TaSBEIIa-B allele with mutations introduced by TALEN pair TaSBEIIa_T03

SEQ ID NO: 2497 - DNA, 452 bp, Artificial; identical to SEQ ID NO: 2202
  TaSBEIIa-B allele with mutations introduced by TALEN pair TaSBEIIa_T03

SEQ ID NO: 2498 - DNA, 515 bp, Artificial; identical to SEQ ID NO: 2379
  TaSBEIIa-B allele with mutations introduced by TALEN pair TaSBEIIa_T03

SEQ ID NO: 2499 - DNA, 445 bp, Artificial; identical to SEQ ID NO: 2222
  TaSBEIIa-B allele with mutations introduced by TALEN pair TaSBEIIa_T03

SEQ ID NO: 2500 - DNA, 452 bp, Artificial; identical to SEQ ID NO: 2202
  TaSBEIIa-B allele with mutations introduced by TALEN pair TaSBEIIa_T03

SEQ ID NO: 2501 - DNA, 493 bp, Artificial; identical to SEQ ID NO: 2310
  TaSBEIIa-B allele with mutations introduced by TALEN pair TaSBEIIa_T03

SEQ ID NO: 2502 - DNA, 444 bp, Artificial
  TaSBEIIa-B allele with mutations introduced by TALEN pair TaSBEIIa_T03
gagatagctggattaggcgatcgcctcaggcccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcgtgcctgacggtgagagcgacgacttggcggccactccagcgcaacccgaagaattacaggtacacaccgtcgtgccggaaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2503 - DNA, 451 bp, Artificial; identical to SEQ ID NO: 2247
  TaSBEIIa-B allele with mutations introduced by TALEN pair TaSBEIIa_T03

SEQ ID NO: 2504 - DNA, 514 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagggcgagcggtatcagctcactcaaaggcggtaatacggttatccacagaatcaggggaaaggtcctggtgcctgacggtgagagcgacgacttggcggccactccagcgcaacccgaagaattacaggtacacaccgtcgtgccggaaaatcttcatgcacccgttattcacttaccaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2505 - DNA, 452 bp, Artificial; identical to SEQ ID NO: 2202
  TaSBEIIa-B allele with mutations introduced by TALEN pair TaSBEIIa_T03

SEQ ID NO: 2506 - DNA, 452 bp, Artificial; identical to SEQ ID NO: 2202
  TaSBEIIa-B allele with mutations introduced by TALEN pair TaSBEIIa_T03

SEQ ID NO: 2507 - DNA, 430 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgc

SEQ ID NO: 2508 - DNA, 439 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2509 - DNA, 453 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcaggcattgtgcactacttcactgccttgtgcagtttgttagctgtggccccgcgctggctcttgggcca

SEQ ID NO: 2510 - DNA, 443 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggccttcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2511 - DNA, 431 bp, Artificial; identical to SEQ ID NO: 2201
  TaSBEIIa-B allele with mutations introduced by TALEN pair TaSBEIIa_T03

SEQ ID NO: 2512 - DNA, 451 bp, Artificial; identical to SEQ ID NO: 2247
  TaSBEIIa-B allele with mutations introduced by TALEN pair TaSBEIIa_T03

SEQ ID NO: 2513 - DNA, 445 bp, Artificial; identical to SEQ ID NO: 2217
  TaSBEIIa-B allele with mutations introduced by TALEN pair TaSBEIIa_T03

SEQ ID NO: 2514 - DNA, 504 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagcgtttctgggtgagcaaaaacaggaaggcaaaatgccgcaaaaagggaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2515 - DNA, 503 bp, Artificial; identical to SEQ ID NO: 2271
  TaSBEIIa-B allele with mutations introduced by TALEN pair TaSBEIIa_T03

SEQ ID NO: 2516 - DNA, 452 bp, Artificial; identical to SEQ ID NO: 2202
  TaSBEIIa-B allele with mutations introduced by TALEN pair TaSBEIIa_T03

SEQ ID NO: 2517 - DNA, 451 bp, Artificial; identical to SEQ ID NO: 2247
  TaSBEIIa-B allele with mutations introduced by TALEN pair TaSBEIIa_T03

SEQ ID NO: 2518 - DNA, 453 bp, Artificial; identical to SEQ ID NO: 2283
  TaSBEIIa-B allele with mutations introduced by TALEN pair TaSBEIIa_T03

SEQ ID NO: 2519 - DNA, 452 bp, Artificial; identical to SEQ ID NO: 2202
  TaSBEIIa-B allele with mutations introduced by TALEN pair TaSBEIIa_T03

SEQ ID NO: 2520 - DNA, 487 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccagggcgagcggtatcagctcactcaaaggcggtaatacggttatccacagaatcagggaaaggtcctggtgcctgacggtgagagcgacgacttggcggccactccagcgcaacccgaagaattacaggtacacaccgtcgtgccggaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2521 - DNA, 445 bp, Artificial; identical to SEQ ID NO: 2217
  TaSBEIIa-B allele with mutations introduced by TALEN pair TaSBEIIa_T03

SEQ ID NO: 2522 - DNA, 507 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaatcttcatgcacccgttattcacttaccaaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2523 - DNA, 439 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgct

SEQ ID NO: 2524 - DNA, 445 bp, Artificial; identical to SEQ ID NO: 2217
  TaSBEIIa-B allele with mutations introduced by TALEN pair TaSBEIIa_T03

SEQ ID NO: 2525 - DNA, 445 bp, Artificial; identical to SEQ ID NO: 2217
  TaSBEIIa-B allele with mutations introduced by TALEN pair TaSBEIIa_T03

SEQ ID NO: 2526 - DNA, 439 bp, Artificial; identical to SEQ ID NO: 2266
  TaSBEIIa-B allele with mutations introduced by TALEN pair TaSBEIIa_T03

SEQ ID NO: 2527 - DNA, 445 bp, Artificial; identical to SEQ ID NO: 2217
  TaSBEIIa-B allele with mutations introduced by TALEN pair TaSBEIIa_T03

SEQ ID NO: 2528 - DNA, 500 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagggcgagcggtatcagctcactcaaaggcggtaatacggttatccacagaatcaggggaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcaccttgcttgtgcagtttgttagctgtggccccgcgct

SEQ ID NO: 2529 - DNA, 416 bp, Artificial; identical to SEQ ID NO: 2216
  TaSBEIIa-B allele with mutations introduced by TALEN pair TaSBEIIa_T03

SEQ ID NO: 2530 - DNA, 435 bp, Artificial; identical to SEQ ID NO: 2252
  TaSBEIIa-B allele with mutations introduced by TALEN pair TaSBEIIa_T03

SEQ ID NO: 2531 - DNA, 438 bp, Artificial; identical to SEQ ID NO: 2225
  TaSBEIIa-B allele with mutations introduced by TALEN pair TaSBEIIa_T03

SEQ ID NO: 2532 - DNA, 444 bp, Artificial; identical to SEQ ID NO: 2264
  TaSBEIIa-B allele with mutations introduced by TALEN pair TaSBEIIa_T03

SEQ ID NO: 2533 - DNA, 446 bp, Artificial; identical to SEQ ID NO: 2194
  TaSBEIIa-B allele with mutations introduced by TALEN pair TaSBEIIa_T03

SEQ ID NO: 2534 - DNA, 445 bp, Artificial; identical to SEQ ID NO: 2217
  TaSBEIIa-B allele with mutations introduced by TALEN pair TaSBEIIa_T03

SEQ ID NO: 2535 - DNA, 445 bp, Artificial; identical to SEQ ID NO: 2217
  TaSBEIIa-B allele with mutations introduced by TALEN pair TaSBEIIa_T03

SEQ ID NO: 2536 - DNA, 446 bp, Artificial; identical to SEQ ID NO: 2194
  TaSBEIIa-B allele with mutations introduced by TALEN pair TaSBEIIa_T03

SEQ ID NO: 2537 - DNA, 453 bp, Artificial; identical to SEQ ID NO: 2283
  TaSBEIIa-B allele with mutations introduced by TALEN pair TaSBEIIa_T03

SEQ ID NO: 2538 - DNA, 510 bp, Artificial; identical to SEQ ID NO: 2277
  TaSBEIIa-B allele with mutations introduced by TALEN pair TaSBEIIa_T03

SEQ ID NO: 2539 - DNA, 434 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccg

SEQ ID NO: 2540 - DNA, 502 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttggcaaataagttgtagcattgtctcagtattgtactcatccttgcatttgcaggcgccgtcctgagccgcgcggcctctccagcgtttctgggtgagcaaaaacaggaaggcaaaatgccgcaaaaagggaaggtcctggtgcctgacggtgagagcgacgacttggcggccactccagcgcaacccgaagaattacaggtacacaccgtcgtgccggaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2541 - DNA, 446 bp, Artificial; identical to SEQ ID NO: 2194
  TaSBEIIa-B allele with mutations introduced by TALEN pair TaSBEIIa_T03

SEQ ID NO: 2542 - DNA, 439 bp, Artificial; identical to SEQ ID NO: 2508
  TaSBEIIa-B allele with mutations introduced by TALEN pair TaSBEIIa_T03

SEQ ID NO: 2543 - DNA, 439 bp, Artificial; identical to SEQ ID NO: 2508
  TaSBEIIa-B allele with mutations introduced by TALEN pair TaSBEIIa_T03

SEQ ID NO: 2544 - DNA, 451 bp, Artificial; identical to SEQ ID NO: 2247
  TaSBEIIa-B allele with mutations introduced by TALEN pair TaSBEIIa_T03

SEQ ID NO: 2545 - DNA, 508 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacagacttggcggccactccagcgcaacccgaagaattacaggtacacaccgtcgtgccggaaaatcttcatgcacccgttattcacttaccaaaatatcggatgaaccaagccgcggaggcatcaggtttcaagcttcttctatcagcattgtgcactacttcactgccttgtgcagttgttagctgtggccccgcgctggctcttgggccactg

SEQ ID NO: 2546 - DNA, 493 bp, Artificial; identical to SEQ ID NO: 2310
  TaSBEIIa-B allele with mutations introduced by TALEN pair TaSBEIIa_T03

SEQ ID NO: 2547 - DNA, 493 bp, Artificial; identical to SEQ ID NO: 2310
  TaSBEIIa-B allele with mutations introduced by TALEN pair TaSBEIIa_T03

SEQ ID NO: 2548 - DNA, 452 bp, Artificial; identical to SEQ ID NO: 2202
  TaSBEIIa-B allele with mutations introduced by TALEN pair TaSBEIIa_T03

SEQ ID NO: 2549 - DNA, 452 bp, Artificial; identical to SEQ ID NO: 2202
  TaSBEIIa-B allele with mutations introduced by TALEN pair TaSBEIIa_T03

SEQ ID NO: 2550 - DNA, 445 bp, Artificial; identical to SEQ ID NO: 2217
  TaSBEIIa-B allele with mutations introduced by TALEN pair TaSBEIIa_T03

SEQ ID NO: 2551 - DNA, 427 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctg

SEQ ID NO: 2552 - DNA, 518 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcgggcctctccagggcgagcggtatcagctcactcaaaggcggtaatacggttatccagcagaatcagggaaggtcctggtgcctgacggtgagagcgacgacttggcggccactccagcgcaacccgaagaattacaggtacacaccgtccgatgccggaaaatcttcatcgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2553 - DNA, 445 bp, Artificial; identical to SEQ ID NO: 2217
  TaSBEIIa-B allele with mutations introduced by TALEN pair TaSBEIIa_T03

SEQ ID NO: 2554 - DNA, 439 bp, Artificial; identical to SEQ ID NO: 2266
  TaSBEIIa-B allele with mutations introduced by TALEN pair TaSBEIIa_T03

SEQ ID NO: 2555 - DNA, 443 bp, Artificial; identical to SEQ ID NO: 2352
  TaSBEIIa-B allele with mutations introduced by TALEN pair TaSBEIIa_T03

SEQ ID NO: 2556 - DNA, 452 bp, Artificial; identical to SEQ ID NO: 2202
  TaSBEIIa-B allele with mutations introduced by TALEN pair TaSBEIIa_T03

SEQ ID NO: 2557 - DNA, 439 bp, Artificial; identical to SEQ ID NO: 2266
  TaSBEIIa-B allele with mutations introduced by TALEN pair TaSBEIIa_T03

SEQ ID NO: 2558 - DNA, 439 bp, Artificial; identical to SEQ ID NO: 2508
  TaSBEIIa-B allele with mutations introduced by TALEN pair TaSBEIIa_T03

SEQ ID NO: 2559 - DNA, 444 bp, Artificial
  TaSBEIIa-B allele with mutations introduced by TALEN pair TaSBEIIa_T03
  misc_feature (231): n is a or c or t or g
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggccttcctggtgcctgacggtgagagngacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2560 - DNA, 452 bp, Artificial; identical to SEQ ID NO: 2202
  TaSBEIIa-B allele with mutations introduced by TALEN pair TaSBEIIa_T03

SEQ ID NO: 2561 - DNA, 445 bp, Artificial; identical to SEQ ID NO: 2217
  TaSBEIIa-B allele with mutations introduced by TALEN pair TaSBEIIa_T03

SEQ ID NO: 2562 - DNA, 438 bp, Artificial; identical to SEQ ID NO: 2225
  TaSBEIIa-B allele with mutations introduced by TALEN pair TaSBEIIa_T03

SEQ ID NO: 2563 - DNA, 431 bp, Artificial; identical to SEQ ID NO: 2201
  TaSBEIIa-B allele with mutations introduced by TALEN pair TaSBEIIa_T03

SEQ ID NO: 2564 - DNA, 452 bp, Artificial; identical to SEQ ID NO: 2202
  TaSBEIIa-B allele with mutations introduced by TALEN pair TaSBEIIa_T03

SEQ ID NO: 2565 - DNA, 427 bp, Artificial
  TaSBEIIa-B allele with mutations introduced by TALEN pair TaSBEIIa_T03
gagatagctggattaggcgatcgcctcaggccctgtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccg

SEQ ID NO: 2566 - DNA, 446 bp, Artificial; identical to SEQ ID NO: 2194
  TaSBEIIa-B allele with mutations introduced by TALEN pair TaSBEIIa_T03

SEQ ID NO: 2567 - DNA, 442 bp, Artificial; identical to SEQ ID NO: 2319
  TaSBEIIa-B allele with mutations introduced by TALEN pair TaSBEIIa_T03

SEQ ID NO: 2568 - DNA, 451 bp, Artificial; identical to SEQ ID NO: 2247
  TaSBEIIa-B allele with mutations introduced by TALEN pair TaSBEIIa_T03

SEQ ID NO: 2569 - DNA, 453 bp, Artificial
  TaSBEIIa-B allele with mutations introduced by TALEN pair TaSBEIIa_T03
gagatagctggattaggcgatcgcctcaggccctggtgcttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2570 - DNA, 445 bp, Artificial; identical to SEQ ID NO: 2217
  TaSBEIIa-B allele with mutations introduced by TALEN pair TaSBEIIa_T03

SEQ ID NO: 2571 - DNA, 443 bp, Artificial; identical to SEQ ID NO: 2510
  TaSBEIIa-B allele with mutations introduced by TALEN pair TaSBEIIa_T03

SEQ ID NO: 2572 - DNA, 437 bp, Artificial; identical to SEQ ID NO: 2206
  TaSBEIIa-B allele with mutations introduced by TALEN pair TaSBEIIa_T03

SEQ ID NO: 2573 - DNA, 452 bp, Artificial; identical to SEQ ID NO: 2202
  TaSBEIIa-B allele with mutations introduced by TALEN pair TaSBEIIa_T03

SEQ ID NO: 2574 - DNA, 510 bp, Artificial; identical to SEQ ID NO: 2277
  TaSBEIIa-B allele with mutations introduced by TALEN pair TaSBEIIa_T03

SEQ ID NO: 2575 - DNA, 452 bp, Artificial; identical to SEQ ID NO: 2202
  TaSBEIIa-B allele with mutations introduced by TALEN pair TaSBEIIa_T03

SEQ ID NO: 2576 - DNA, 446 bp, Artificial; identical to SEQ ID NO: 2194
  TaSBEIIa-B allele with mutations introduced by TALEN pair TaSBEIIa_T03

SEQ ID NO: 2577 - DNA, 503 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagcgtttctgggtgagcaaaacaggaaggcaaaatgccgcaaaaagggaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2578 - DNA, 445 bp, Artificial; identical to SEQ ID NO: 2217
  TaSBEIIa-B allele with mutations introduced by TALEN pair TaSBEIIa_T03

SEQ ID NO: 2579 - DNA, 439 bp, Artificial; identical to SEQ ID NO: 2266
  TaSBEIIa-B allele with mutations introduced by TALEN pair TaSBEIIa_T03

SEQ ID NO: 2580 - DNA, 514 bp, Artificial; identical to SEQ ID NO: 2395
  TaSBEIIa-B allele with mutations introduced by TALEN pair TaSBEIIa_T03

SEQ ID NO: 2581 - DNA, 452 bp, Artificial; identical to SEQ ID NO: 2202
  TaSBEIIa-B allele with mutations introduced by TALEN pair TaSBEIIa_T03

SEQ ID NO: 2582 - DNA, 453 bp, Artificial
  TaSBEIIa-B allele with mutations introduced by TALEN pair TaSBEIIa_T03
  misc_feature (320): n is a or c or t or g
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttnttcaccttaccaaatatcggatgaaccaaggccgcggaggcatcaggtttcaagcttcttctatcagcattgtgcactacttcactgccttgtgcagtttgttagctgtggccccgcgctggctcttgggcca

SEQ ID NO: 2583 - DNA, 493 bp, Artificial; identical to SEQ ID NO: 2310
  TaSBEIIa-B allele with mutations introduced by TALEN pair TaSBEIIa_T03

SEQ ID NO: 2584 - DNA, 452 bp, Artificial; identical to SEQ ID NO: 2202
  TaSBEIIa-B allele with mutations introduced by TALEN pair TaSBEIIa_T03

SEQ ID NO: 2585 - DNA, 444 bp, Artificial; identical to SEQ ID NO: 2264
  TaSBEIIa-B allele with mutations introduced by TALEN pair TaSBEIIa_T03

SEQ ID NO: 2586 - DNA, 452 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgactttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2587 - DNA, 451 bp, Artificial; identical to SEQ ID NO: 2247
  TaSBEIIa-B allele with mutations introduced by TALEN pair TaSBEIIa_T03

SEQ ID NO: 2588 - DNA, 452 bp, Artificial; identical to SEQ ID NO: 2202
  TaSBEIIa-B allele with mutations introduced by TALEN pair TaSBEIIa_T03

SEQ ID NO: 2589 - DNA, 451 bp, Artificial; identical to SEQ ID NO: 2247
  TaSBEIIa-B allele with mutations introduced by TALEN pair TaSBEIIa_T03

SEQ ID NO: 2590 - DNA, 453 bp, Artificial; identical to SEQ ID NO: 2283
  TaSBEIIa-B allele with mutations introduced by TALEN pair TaSBEIIa_T03

SEQ ID NO: 2591 - DNA, 452 bp, Artificial; identical to SEQ ID NO: 2202
  TaSBEIIa-B allele with mutations introduced by TALEN pair TaSBEIIa_T03

SEQ ID NO: 2592 - DNA, 513 bp, Artificial; identical to SEQ ID NO: 2366
  TaSBEIIa-B allele with mutations introduced by TALEN pair TaSBEIIa_T03

SEQ ID NO: 2593 - DNA, 439 bp, Artificial; identical to SEQ ID NO: 2266
  TaSBEIIa-B allele with mutations introduced by TALEN pair TaSBEIIa_T03

SEQ ID NO: 2594 - DNA, 452 bp, Artificial; identical to SEQ ID NO: 2202
  TaSBEIIa-B allele with mutations introduced by TALEN pair TaSBEIIa_T03

SEQ ID NO: 2595 - DNA, 452 bp, Artificial; identical to SEQ ID NO: 2202
  TaSBEIIa-B allele with mutations introduced by TALEN pair TaSBEIIa_T03

SEQ ID NO: 2596 - DNA, 452 bp, Artificial; identical to SEQ ID NO: 2202
  TaSBEIIa-B allele with mutations introduced by TALEN pair TaSBEIIa_T03

SEQ ID NO: 2597 - DNA, 452 bp, Artificial; identical to SEQ ID NO: 2202
  TaSBEIIa-B allele with mutations introduced by TALEN pair TaSBEIIa_T03

SEQ ID NO: 2598 - DNA, 439 bp, Artificial; identical to SEQ ID NO: 2508
  TaSBEIIa-B allele with mutations introduced by TALEN pair TaSBEIIa_T03

SEQ ID NO: 2599 - DNA, 446 bp, Artificial; identical to SEQ ID NO: 2194
  TaSBEIIa-B allele with mutations introduced by TALEN pair TaSBEIIa_T03

SEQ ID NO: 2600 - DNA, 452 bp, Artificial; identical to SEQ ID NO: 2202
  TaSBEIIa-B allele with mutations introduced by TALEN pair TaSBEIIa_T03

SEQ ID NO: 2601 - DNA, 452 bp, Artificial; identical to SEQ ID NO: 2202
  TaSBEIIa-B allele with mutations introduced by TALEN pair TaSBEIIa_T03

SEQ ID NO: 2602 - DNA, 447 bp, Artificial; identical to SEQ ID NO: 2463
  TaSBEIIa-B allele with mutations introduced by TALEN pair TaSBEIIa_T03

SEQ ID NO: 2603 - DNA, 445 bp, Artificial; identical to SEQ ID NO: 2217
  TaSBEIIa-B allele with mutations introduced by TALEN pair TaSBEIIa_T03

SEQ ID NO: 2604 - DNA, 444 bp, Artificial; identical to SEQ ID NO: 2228
  TaSBEIIa-B allele with mutations introduced by TALEN pair TaSBEIIa_T03

SEQ ID NO: 2605 - DNA, 452 bp, Artificial; identical to SEQ ID NO: 2202
  TaSBEIIa-B allele with mutations introduced by TALEN pair TaSBEIIa_T03

SEQ ID NO: 2606 - DNA, 452 bp, Artificial; identical to SEQ ID NO: 2202
  TaSBEIIa-B allele with mutations introduced by TALEN pair TaSBEIIa_T03

SEQ ID NO: 2607 - DNA, 445 bp, Artificial; identical to SEQ ID NO: 2217
  TaSBEIIa-B allele with mutations introduced by TALEN pair TaSBEIIa_T03

SEQ ID NO: 2608 - DNA, 439 bp, Artificial; identical to SEQ ID NO: 2508
  TaSBEIIa-B allele with mutations introduced by TALEN pair TaSBEIIa_T03

SEQ ID NO: 2609 - DNA, 591 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcgggcgaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgc

SEQ ID NO: 2610 - DNA, 452 bp, Artificial; identical to SEQ ID NO: 2202
  TaSBEIIa-B allele with mutations introduced by TALEN pair TaSBEIIa_T03

SEQ ID NO: 2611 - DNA, 493 bp, Artificial; identical to SEQ ID NO: 2310
  TaSBEIIa-B allele with mutations introduced by TALEN pair TaSBEIIa_T03

SEQ ID NO: 2612 - DNA, 452 bp, Artificial; identical to SEQ ID NO: 2202
  TaSBEIIa-B allele with mutations introduced by TALEN pair TaSBEIIa_T03

SEQ ID NO: 2613 - DNA, 515 bp, Artificial; identical to SEQ ID NO: 2379
  TaSBEIIa-B allele with mutations introduced by TALEN pair TaSBEIIa_T03

SEQ ID NO: 2614 - DNA, 510 bp, Artificial; identical to SEQ ID NO: 2277
  TaSBEIIa-B allele with mutations introduced by TALEN pair TaSBEIIa_T03

SEQ ID NO: 2615 - DNA, 414 bp, Artificial
  TaSBEIIa-B allele with mutations introduced by TALEN pair TaSBEIIa_T03
gagatagctggattaggcgatcgcctcaggccctgtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcag

SEQ ID NO: 2616 - DNA, 453 bp, Artificial; identical to SEQ ID NO: 2283
  TaSBEIIa-B allele with mutations introduced by TALEN pair TaSBEIIa_T03

SEQ ID NO: 2617 - DNA, 438 bp, Artificial; identical to SEQ ID NO: 2391
  TaSBEIIa-B allele with mutations introduced by TALEN pair TaSBEIIa_T03

SEQ ID NO: 2618 - DNA, 499 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagggcgagcggtatcagctcactcaaaggcggtaatacggttatccacagaatcaggggaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgct

SEQ ID NO: 2619 - DNA, 514 bp, Artificial; identical to SEQ ID NO: 2395
  TaSBEIIa-B allele with mutations introduced by TALEN pair TaSBEIIa_T03

SEQ ID NO: 2620 - DNA, 462 bp, Artificial
  TaSBEIIa-B allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2621 - DNA, 452 bp, Artificial; identical to SEQ ID NO: 2202
  TaSBEIIa-B allele with mutations introduced by TALEN pair TaSBEIIa_T03

SEQ ID NO: 2622 - DNA, 451 bp, Artificial; identical to SEQ ID NO: 2247
  TaSBEIIa-B allele with mutations introduced by TALEN pair TaSBEIIa_T03

SEQ ID NO: 2623 - DNA, 439 bp, Artificial; identical to SEQ ID NO: 2266
  TaSBEIIa-B allele with mutations introduced by TALEN pair TaSBEIIa_T03

SEQ ID NO: 2624 - DNA, 443 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctcgtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2625 - DNA, 439 bp, Artificial
  TaSBEIIa-B allele with mutations introduced by TALEN pair TaSBEIIa_T03
gagatagctggattaggcgatcgccccaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2626 - DNA, 491 bp, Artificial; identical to SEQ ID NO: 2295
  TaSBEIIa-B allele with mutations introduced by TALEN pair TaSBEIIa_T03

SEQ ID NO: 2627 - DNA, 439 bp, Artificial; identical to SEQ ID NO: 2266
  TaSBEIIa-B allele with mutations introduced by TALEN pair TaSBEIIa_T03

SEQ ID NO: 2628 - DNA, 515 bp, Artificial; identical to SEQ ID NO: 2379
  TaSBEIIa-B allele with mutations introduced by TALEN pair TaSBEIIa_T03

SEQ ID NO: 2629 - DNA, 439 bp, Artificial
  TaSBEIIa-B allele with mutations introduced by TALEN pair TaSBEIIa_T03
  misc_feature (164): n is a or c or t or g
gagatagctggattaggcgatcgcctcaggcccctggtgttaccacggctttgatcatctcctcctttcatgctgatattttctcactctttcttctgttcttgctgtaactgcaagtgtagcatttttttggcaaataagttgtagcattgtctcagtattgnactcatccttgcatttgcaggcgccgtcctgagccgcgcggcctctccctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2630 - DNA, 452 bp, Artificial; identical to SEQ ID NO: 2202
  TaSBEIIa-B allele with mutations introduced by TALEN pair TaSBEIIa_T03

SEQ ID NO: 2631 - DNA, 452 bp, Artificial; identical to SEQ ID NO: 2202
  TaSBEIIa-B allele with mutations introduced by TALEN pair TaSBEIIa_T03

SEQ ID NO: 2632 - DNA, 590 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcggggcgaaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccg

SEQ ID NO: 2633 - DNA, 516 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtatgcatttttttggcaaataagttgtagcattgtctcagtattgtactcatccttgcatttgcaggcgccgttctgagccgcgcggcctctccagggcgagcggtatcagctcactcaaaggcggtaatacggttatccacagaatcaggggaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2634 - DNA, 444 bp, Artificial; identical to SEQ ID NO: 2303
  TaSBEIIa-B allele with mutations introduced by TALEN pair TaSBEIIa_T03

SEQ ID NO: 2635 - DNA, 452 bp, Artificial; identical to SEQ ID NO: 2202
  TaSBEIIa-B allele with mutations introduced by TALEN pair TaSBEIIa_T03

SEQ ID NO: 2636 - DNA, 452 bp, Artificial; identical to SEQ ID NO: 2202
  TaSBEIIa-B allele with mutations introduced by TALEN pair TaSBEIIa_T03

SEQ ID NO: 2637 - DNA, 445 bp, Artificial; identical to SEQ ID NO: 2217
  TaSBEIIa-B allele with mutations introduced by TALEN pair TaSBEIIa_T03

SEQ ID NO: 2638 - DNA, 451 bp, Artificial; identical to SEQ ID NO: 2247
  TaSBEIIa-B allele with mutations introduced by TALEN pair TaSBEIIa_T03

SEQ ID NO: 2639 - DNA, 445 bp, Artificial; identical to SEQ ID NO: 2217
  TaSBEIIa-B allele with mutations introduced by TALEN pair TaSBEIIa_T03

SEQ ID NO: 2640 - DNA, 452 bp, Artificial; identical to SEQ ID NO: 2202
  TaSBEIIa-B allele with mutations introduced by TALEN pair TaSBEIIa_T03

SEQ ID NO: 2641 - DNA, 410 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcaggaggcatcaggtttcaagcttcttctatcagcattgtgcactacttcactgcttg

SEQ ID NO: 2642 - DNA, 452 bp, Artificial; identical to SEQ ID NO: 2202
  TaSBEIIa-B allele with mutations introduced by TALEN pair TaSBEIIa_T03

SEQ ID NO: 2643 - DNA, 452 bp, Artificial; identical to SEQ ID NO: 2202
  TaSBEIIa-B allele with mutations introduced by TALEN pair TaSBEIIa_T03

SEQ ID NO: 2644 - DNA, 451 bp, Artificial; identical to SEQ ID NO: 2247
  TaSBEIIa-B allele with mutations introduced by TALEN pair TaSBEIIa_T03

SEQ ID NO: 2645 - DNA, 515 bp, Artificial; identical to SEQ ID NO: 2379
  TaSBEIIa-B allele with mutations introduced by TALEN pair TaSBEIIa_T03

SEQ ID NO: 2646 - DNA, 452 bp, Artificial; identical to SEQ ID NO: 2202
  TaSBEIIa-B allele with mutations introduced by TALEN pair TaSBEIIa_T03

SEQ ID NO: 2647 - DNA, 439 bp, Artificial; identical to SEQ ID NO: 2508
  TaSBEIIa-B allele with mutations introduced by TALEN pair TaSBEIIa_T03

SEQ ID NO: 2648 - DNA, 514 bp, Artificial; identical to SEQ ID NO: 2395
  TaSBEIIa-B allele with mutations introduced by TALEN pair TaSBEIIa_T03

SEQ ID NO: 2649 - DNA, 435 bp, Artificial; identical to SEQ ID NO: 2252
  TaSBEIIa-B allele with mutations introduced by TALEN pair TaSBEIIa_T03

SEQ ID NO: 2650 - DNA, 444 bp, Artificial; identical to SEQ ID NO: 2264
  TaSBEIIa-B allele with mutations introduced by TALEN pair TaSBEIIa_T03

SEQ ID NO: 2651 - DNA, 453 bp, Artificial; identical to SEQ ID NO: 2283
  TaSBEIIa-B allele with mutations introduced by TALEN pair TaSBEIIa_T03

SEQ ID NO: 2652 - DNA, 452 bp, Artificial; identical to SEQ ID NO: 2202
  TaSBEIIa-B allele with mutations introduced by TALEN pair TaSBEIIa_T03

SEQ ID NO: 2653 - DNA, 434 bp, Artificial
  TaSBEIIa-B allele with mutations introduced by TALEN pair TaSBEIIa_T03
gagatagctggattaggcgatcgcctcaggccctgtgttatccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctcctggtgcctgacggtgagagcgacgacttggcggccactccagcgcaacccgagaattatcaggtacacaccgtcgtgccggaaaatcttcatgcacccgtttattcacttaccaaatatcggatgaaccaagccgcggaggcatcaggtttcaagcttcttctatcagcattgtgcactacttcactgccttgtgcagtttgttagctgtggccccgccgc

SEQ ID NO: 2654 - DNA, 452 bp, Artificial; identical to SEQ ID NO: 2202
  TaSBEIIa-B allele with mutations introduced by TALEN pair TaSBEIIa_T03

SEQ ID NO: 2655 - DNA, 493 bp, Artificial; identical to SEQ ID NO: 2310
  TaSBEIIa-B allele with mutations introduced by TALEN pair TaSBEIIa_T03

SEQ ID NO: 2656 - DNA, 445 bp, Artificial; identical to SEQ ID NO: 2217
  TaSBEIIa-B allele with mutations introduced by TALEN pair TaSBEIIa_T03

SEQ ID NO: 2657 - DNA, 510 bp, Artificial; identical to SEQ ID NO: 2277
  TaSBEIIa-B allele with mutations introduced by TALEN pair TaSBEIIa_T03

SEQ ID NO: 2658 - DNA, 453 bp, Artificial; identical to SEQ ID NO: 2283
  TaSBEIIa-B allele with mutations introduced by TALEN pair TaSBEIIa_T03

SEQ ID NO: 2659 - DNA, 503 bp, Artificial; identical to SEQ ID NO: 2271
  TaSBEIIa-B allele with mutations introduced by TALEN pair TaSBEIIa_T03

SEQ ID NO: 2660 - DNA, 452 bp, Artificial; identical to SEQ ID NO: 2202
  TaSBEIIa-B allele with mutations introduced by TALEN pair TaSBEIIa_T03

SEQ ID NO: 2661 - DNA, 435 bp, Artificial
  TaSBEIIa-B allele with mutations introduced by TALEN pair TaSBEIIa_T03
  misc_feature (42): n is a or c or t or g
gagatagctggattaggcgatcgcctcaggccctgctggttntccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagtgctggcgctgacggtgagagcgacgacttggcggccactccagcgcaacccgcagaatatcaggtacacaccgtcgtgccggaaaaatcttcatgcaacccgtctattcacttaccaaatatcggatgaaccaagccgcggaggcatcaggtttcaagcttcttctatcagcattgtgcactacttcactgccttgtgcagtttgttagctgtggccc

SEQ ID NO: 2662 - DNA, 510 bp, Artificial; identical to SEQ ID NO: 2277
  TaSBEIIa-B allele with mutations introduced by TALEN pair TaSBEIIa_T03

SEQ ID NO: 2663 - DNA, 445 bp, Artificial; identical to SEQ ID NO: 2217
  TaSBEIIa-B allele with mutations introduced by TALEN pair TaSBEIIa_T03

SEQ ID NO: 2664 - DNA, 451 bp, Artificial; identical to SEQ ID NO: 2247
  TaSBEIIa-B allele with mutations introduced by TALEN pair TaSBEIIa_T03

SEQ ID NO: 2665 - DNA, 445 bp, Artificial; identical to SEQ ID NO: 2217
  TaSBEIIa-B allele with mutations introduced by TALEN pair TaSBEIIa_T03

SEQ ID NO: 2666 - DNA, 452 bp, Artificial; identical to SEQ ID NO: 2202
  TaSBEIIa-B allele with mutations introduced by TALEN pair TaSBEIIa_T03

SEQ ID NO: 2667 - DNA, 452 bp, Artificial; identical to SEQ ID NO: 2202
  TaSBEIIa-B allele with mutations introduced by TALEN pair TaSBEIIa_T03

SEQ ID NO: 2668 - DNA, 452 bp, Artificial; identical to SEQ ID NO: 2202
  TaSBEIIa-B allele with mutations introduced by TALEN pair TaSBEIIa_T03

SEQ ID NO: 2669 - DNA, 451 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggccttcctggtgcctgacggtgagagcgacgacttggcggccactccagcgcaacccgaagaattacaggtacacaccgtccgatgccggaaaatcttccattgcaccccgttaattcacttaccaaatatcggatgaaccaaggccgcggaggcatcaggtttcaagcttcttctatcagcattgtgcactacttcactgccttgtgcagtttgttagctgtggccccgcgctggctcttgggcca

SEQ ID NO: 2670 - DNA, 435 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacaggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggcccc

SEQ ID NO: 2671 - DNA, 451 bp, Artificial; identical to SEQ ID NO: 2247
  TaSBEIIa-B allele with mutations introduced by TALEN pair TaSBEIIa_T03

SEQ ID NO: 2672 - DNA, 452 bp, Artificial; identical to SEQ ID NO: 2202
  TaSBEIIa-B allele with mutations introduced by TALEN pair TaSBEIIa_T03

SEQ ID NO: 2673 - DNA, 514 bp, Artificial; identical to SEQ ID NO: 2395
  TaSBEIIa-B allele with mutations introduced by TALEN pair TaSBEIIa_T03

SEQ ID NO: 2674 - DNA, 452 bp, Artificial; identical to SEQ ID NO: 2202
  TaSBEIIa-B allele with mutations introduced by TALEN pair TaSBEIIa_T03

SEQ ID NO: 2675 - DNA, 445 bp, Artificial; identical to SEQ ID NO: 2217
  TaSBEIIa-B allele with mutations introduced by TALEN pair TaSBEIIa_T03

SEQ ID NO: 2676 - DNA, 451 bp, Artificial; identical to SEQ ID NO: 2247
  TaSBEIIa-B allele with mutations introduced by TALEN pair TaSBEIIa_T03

SEQ ID NO: 2677 - DNA, 452 bp, Artificial; identical to SEQ ID NO: 2202
  TaSBEIIa-B allele with mutations introduced by TALEN pair TaSBEIIa_T03

SEQ ID NO: 2678 - DNA, 446 bp, Artificial; identical to SEQ ID NO: 2194
  TaSBEIIa-B allele with mutations introduced by TALEN pair TaSBEIIa_T03

SEQ ID NO: 2679 - DNA, 452 bp, Artificial; identical to SEQ ID NO: 2202
  TaSBEIIa-B allele with mutations introduced by TALEN pair TaSBEIIa_T03

SEQ ID NO: 2680 - DNA, 444 bp, Artificial; identical to SEQ ID NO: 2303
  TaSBEIIa-B allele with mutations introduced by TALEN pair TaSBEIIa_T03

SEQ ID NO: 2681 - DNA, 452 bp, Artificial; identical to SEQ ID NO: 2202
  TaSBEIIa-B allele with mutations introduced by TALEN pair TaSBEIIa_T03

SEQ ID NO: 2682 - DNA, 445 bp, Artificial; identical to SEQ ID NO: 2217
  TaSBEIIa-B allele with mutations introduced by TALEN pair TaSBEIIa_T03

SEQ ID NO: 2683 - DNA, 505 bp, Artificial; identical to SEQ ID NO: 2365
  TaSBEIIa-B allele with mutations introduced by TALEN pair TaSBEIIa_T03

SEQ ID NO: 2684 - DNA, 445 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctggcgccgcgccgctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2685 - DNA, 451 bp, Artificial; identical to SEQ ID NO: 2247
  TaSBEIIa-B allele with mutations introduced by TALEN pair TaSBEIIa_T03

SEQ ID NO: 2686 - DNA, 439 bp, Artificial; identical to SEQ ID NO: 2508
  TaSBEIIa-B allele with mutations introduced by TALEN pair TaSBEIIa_T03

SEQ ID NO: 2687 - DNA, 451 bp, Artificial; identical to SEQ ID NO: 2247
  TaSBEIIa-B allele with mutations introduced by TALEN pair TaSBEIIa_T03

SEQ ID NO: 2688 - DNA, 452 bp, Artificial; identical to SEQ ID NO: 2202
  TaSBEIIa-B allele with mutations introduced by TALEN pair TaSBEIIa_T03

SEQ ID NO: 2689 - DNA, 451 bp, Artificial; identical to SEQ ID NO: 2247
  TaSBEIIa-B allele with mutations introduced by TALEN pair TaSBEIIa_T03

SEQ ID NO: 2690 - DNA, 452 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtattgcattttttggcaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2691 - DNA, 426 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgct

SEQ ID NO: 2692 - DNA, 445 bp, Artificial; identical to SEQ ID NO: 2217
  TaSBEIIa-B allele with mutations introduced by TALEN pair TaSBEIIa_T03

SEQ ID NO: 2693 - DNA, 445 bp, Artificial; identical to SEQ ID NO: 2217
  TaSBEIIa-B allele with mutations introduced by TALEN pair TaSBEIIa_T03

SEQ ID NO: 2694 - DNA, 452 bp, Artificial; identical to SEQ ID NO: 2202
  TaSBEIIa-B allele with mutations introduced by TALEN pair TaSBEIIa_T03

SEQ ID NO: 2695 - DNA, 707 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttctttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcaactgccttgtgcagtttgttagctgtggccccgcgctggc

SEQ ID NO: 2696 - DNA, 451 bp, Artificial; identical to SEQ ID NO: 2247
  TaSBEIIa-B allele with mutations introduced by TALEN pair TaSBEIIa_T03

SEQ ID NO: 2697 - DNA, 433 bp, Artificial; identical to SEQ ID NO: 2467
  TaSBEIIa-B allele with mutations introduced by TALEN pair TaSBEIIa_T03

SEQ ID NO: 2698 - DNA, 510 bp, Artificial; identical to SEQ ID NO: 2277
  TaSBEIIa-B allele with mutations introduced by TALEN pair TaSBEIIa_T03

SEQ ID NO: 2699 - DNA, 445 bp, Artificial; identical to SEQ ID NO: 2217
  TaSBEIIa-B allele with mutations introduced by TALEN pair TaSBEIIa_T03

SEQ ID NO: 2700 - DNA, 452 bp, Artificial; identical to SEQ ID NO: 2202
  TaSBEIIa-B allele with mutations introduced by TALEN pair TaSBEIIa_T03

SEQ ID NO: 2701 - DNA, 451 bp, Artificial; identical to SEQ ID NO: 2247
  TaSBEIIa-B allele with mutations introduced by TALEN pair TaSBEIIa_T03

SEQ ID NO: 2702 - DNA, 451 bp, Artificial; identical to SEQ ID NO: 2247
  TaSBEIIa-B allele with mutations introduced by TALEN pair TaSBEIIa_T03

SEQ ID NO: 2703 - DNA, 504 bp, Artificial; identical to SEQ ID NO: 2405
  TaSBEIIa-B allele with mutations introduced by TALEN pair TaSBEIIa_T03

SEQ ID NO: 2704 - DNA, 452 bp, Artificial; identical to SEQ ID NO: 2202
  TaSBEIIa-B allele with mutations introduced by TALEN pair TaSBEIIa_T03

SEQ ID NO: 2705 - DNA, 452 bp, Artificial; identical to SEQ ID NO: 2202
  TaSBEIIa-B allele with mutations introduced by TALEN pair TaSBEIIa_T03

SEQ ID NO: 2706 - DNA, 451 bp, Artificial; identical to SEQ ID NO: 2247
  TaSBEIIa-B allele with mutations introduced by TALEN pair TaSBEIIa_T03

SEQ ID NO: 2707 - DNA, 452 bp, Artificial; identical to SEQ ID NO: 2202
  TaSBEIIa-B allele with mutations introduced by TALEN pair TaSBEIIa_T03

SEQ ID NO: 2708 - DNA, 509 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaatcttcatgcaccccgttattcacttaccaaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2709 - DNA, 452 bp, Artificial; identical to SEQ ID NO: 2202
  TaSBEIIa-B allele with mutations introduced by TALEN pair TaSBEIIa_T03

SEQ ID NO: 2710 - DNA, 452 bp, Artificial; identical to SEQ ID NO: 2202
  TaSBEIIa-B allele with mutations introduced by TALEN pair TaSBEIIa_T03

SEQ ID NO: 2711 - DNA, 453 bp, Artificial; identical to SEQ ID NO: 2283
  TaSBEIIa-B allele with mutations introduced by TALEN pair TaSBEIIa_T03

SEQ ID NO: 2712 - DNA, 452 bp, Artificial; identical to SEQ ID NO: 2202
  TaSBEIIa-B allele with mutations introduced by TALEN pair TaSBEIIa_T03

SEQ ID NO: 2713 - DNA, 504 bp, Artificial; identical to SEQ ID NO: 2514
  TaSBEIIa-B allele with mutations introduced by TALEN pair TaSBEIIa_T03

SEQ ID NO: 2714 - DNA, 430 bp, Artificial; identical to SEQ ID NO: 2455
  TaSBEIIa-B allele with mutations introduced by TALEN pair TaSBEIIa_T03

SEQ ID NO: 2715 - DNA, 438 bp, Artificial; identical to SEQ ID NO: 2225
  TaSBEIIa-B allele with mutations introduced by TALEN pair TaSBEIIa_T03

SEQ ID NO: 2716 - DNA, 510 bp, Artificial; identical to SEQ ID NO: 2277
  TaSBEIIa-B allele with mutations introduced by TALEN pair TaSBEIIa_T03

SEQ ID NO: 2717 - DNA, 451 bp, Artificial; identical to SEQ ID NO: 2247
  TaSBEIIa-B allele with mutations introduced by TALEN pair TaSBEIIa_T03

SEQ ID NO: 2718 - DNA, 452 bp, Artificial; identical to SEQ ID NO: 2202
  TaSBEIIa-B allele with mutations introduced by TALEN pair TaSBEIIa_T03

SEQ ID NO: 2719 - DNA, 451 bp, Artificial; identical to SEQ ID NO: 2247
  TaSBEIIa-B allele with mutations introduced by TALEN pair TaSBEIIa_T03

SEQ ID NO: 2720 - DNA, 608 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcgggcgaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2721 - DNA, 445 bp, Artificial; identical to SEQ ID NO: 2217
  TaSBEIIa-B allele with mutations introduced by TALEN pair TaSBEIIa_T03

SEQ ID NO: 2722 - DNA, 452 bp, Artificial; identical to SEQ ID NO: 2202
  TaSBEIIa-B allele with mutations introduced by TALEN pair TaSBEIIa_T03

SEQ ID NO: 2723 - DNA, 452 bp, Artificial; identical to SEQ ID NO: 2202
  TaSBEIIa-B allele with mutations introduced by TALEN pair TaSBEIIa_T03

SEQ ID NO: 2724 - DNA, 452 bp, Artificial; identical to SEQ ID NO: 2202
  TaSBEIIa-B allele with mutations introduced by TALEN pair TaSBEIIa_T03

SEQ ID NO: 2725 - DNA, 451 bp, Artificial; identical to SEQ ID NO: 2247
  TaSBEIIa-B allele with mutations introduced by TALEN pair TaSBEIIa_T03

SEQ ID NO: 2726 - DNA, 443 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcgtgcctgacggtgagagcgacgacttggcggccactccagcgcaacccgaagaattacaggtacacaccgtcgtgccggaaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2727 - DNA, 422 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2728 - DNA, 493 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaatcttcatgcaccccgttattcacttaccaaaatatcggatgaaccaagccgcggaggcatcaggtttcaagcttcttctatcagcattgtgcactacttcactgccttgtgcagtttgttagctgtggccccgcgct

SEQ ID NO: 2729 - DNA, 445 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaactcgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2730 - DNA, 445 bp, Artificial; identical to SEQ ID NO: 2217
  TaSBEIIa-B allele with mutations introduced by TALEN pair TaSBEIIa_T03

SEQ ID NO: 2731 - DNA, 452 bp, Artificial; identical to SEQ ID NO: 2202
  TaSBEIIa-B allele with mutations introduced by TALEN pair TaSBEIIa_T03

SEQ ID NO: 2732 - DNA, 515 bp, Artificial; identical to SEQ ID NO: 2379
  TaSBEIIa-B allele with mutations introduced by TALEN pair TaSBEIIa_T03

SEQ ID NO: 2733 - DNA, 423 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2734 - DNA, 452 bp, Artificial; identical to SEQ ID NO: 2202
  TaSBEIIa-B allele with mutations introduced by TALEN pair TaSBEIIa_T03

SEQ ID NO: 2735 - DNA, 452 bp, Artificial; identical to SEQ ID NO: 2202
  TaSBEIIa-B allele with mutations introduced by TALEN pair TaSBEIIa_T03

SEQ ID NO: 2736 - DNA, 452 bp, Artificial; identical to SEQ ID NO: 2202
  TaSBEIIa-B allele with mutations introduced by TALEN pair TaSBEIIa_T03

SEQ ID NO: 2737 - DNA, 435 bp, Artificial
  TaSBEIIa-B allele with mutations introduced by TALEN pair TaSBEIIa_T03
  misc_feature (165): n is a or c or t or g
gagatagctggattaggcgatcgcctcaggccctggtgttaccacggctttgatcatctcctcctttcatgctgatatttttctcactctttcttctgttcttgctgtaactgcaagttgtagcatttttttggcaaataagttgtagcattgtctcagtattgnactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggcccc

SEQ ID NO: 2738 - DNA, 445 bp, Artificial; identical to SEQ ID NO: 2217
  TaSBEIIa-B allele with mutations introduced by TALEN pair TaSBEIIa_T03

SEQ ID NO: 2739 - DNA, 452 bp, Artificial; identical to SEQ ID NO: 2202
  TaSBEIIa-B allele with mutations introduced by TALEN pair TaSBEIIa_T03

SEQ ID NO: 2740 - DNA, 453 bp, Artificial; identical to SEQ ID NO: 2283
  TaSBEIIa-B allele with mutations introduced by TALEN pair TaSBEIIa_T03

SEQ ID NO: 2741 - DNA, 510 bp, Artificial; identical to SEQ ID NO: 2277
  TaSBEIIa-B allele with mutations introduced by TALEN pair TaSBEIIa_T03

SEQ ID NO: 2742 - DNA, 509 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctattcttgctgtaactgcaagttgtagcatttttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaatcttcatgcacccgttattcacttaccaaaatatcggatgaaccaagccgcggaggcatcaggtttcaagcttcttctatcagcattgtgcactacttcactgccttgtgcagtttgttagctgtggccccgcgctggtcttgggccactgaa

SEQ ID NO: 2743 - DNA, 493 bp, Artificial; identical to SEQ ID NO: 2310
  TaSBEIIa-B allele with mutations introduced by TALEN pair TaSBEIIa_T03

SEQ ID NO: 2744 - DNA, 452 bp, Artificial; identical to SEQ ID NO: 2202
  TaSBEIIa-B allele with mutations introduced by TALEN pair TaSBEIIa_T03

SEQ ID NO: 2745 - DNA, 451 bp, Artificial; identical to SEQ ID NO: 2247
  TaSBEIIa-B allele with mutations introduced by TALEN pair TaSBEIIa_T03

SEQ ID NO: 2746 - DNA, 493 bp, Artificial; identical to SEQ ID NO: 2310
  TaSBEIIa-B allele with mutations introduced by TALEN pair TaSBEIIa_T03

SEQ ID NO: 2747 - DNA, 452 bp, Artificial; identical to SEQ ID NO: 2202
  TaSBEIIa-B allele with mutations introduced by TALEN pair TaSBEIIa_T03

SEQ ID NO: 2748 - DNA, 444 bp, Artificial; identical to SEQ ID NO: 2228
  TaSBEIIa-B allele with mutations introduced by TALEN pair TaSBEIIa_T03

SEQ ID NO: 2749 - DNA, 439 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgcgg

SEQ ID NO: 2750 - DNA, 422 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctcgtgcctgacggtgagagcgacgacttggcggccactccagcgcaacccgaagaattacaggtacacaccgtcgtgccggaaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2751 - DNA, 445 bp, Artificial; identical to SEQ ID NO: 2217
  TaSBEIIa-B allele with mutations introduced by TALEN pair TaSBEIIa_T03

SEQ ID NO: 2752 - DNA, 491 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagcgtttctgggtgagcaaaaacaggaaggcaaaatgccgcaaaaaagggaaggtcctggtgcctgacggtgagagcgacgacttggcggccactccagcgcaacccgaagaattacaggtacacaccgtcgtgccggaaaatcttcatgcacccgttattcacttacccaaaatatcggatgaaccaagccgcggaggcatcaggtttcaagcttcttctatcagcattgtgcactacttcactgccttgtgcagtttgttagctgtggccccgcgct

SEQ ID NO: 2753 - DNA, 451 bp, Artificial; identical to SEQ ID NO: 2247
  TaSBEIIa-B allele with mutations introduced by TALEN pair TaSBEIIa_T03

SEQ ID NO: 2754 - DNA, 454 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccct

SEQ ID NO: 2755 - DNA, 452 bp, Artificial; identical to SEQ ID NO: 2202
  TaSBEIIa-B allele with mutations introduced by TALEN pair TaSBEIIa_T03

SEQ ID NO: 2756 - DNA, 452 bp, Artificial; identical to SEQ ID NO: 2202
  TaSBEIIa-B allele with mutations introduced by TALEN pair TaSBEIIa_T03

SEQ ID NO: 2757 - DNA, 493 bp, Artificial; identical to SEQ ID NO: 2310
  TaSBEIIa-B allele with mutations introduced by TALEN pair TaSBEIIa_T03

SEQ ID NO: 2758 - DNA, 451 bp, Artificial; identical to SEQ ID NO: 2247
  TaSBEIIa-B allele with mutations introduced by TALEN pair TaSBEIIa_T03

SEQ ID NO: 2759 - DNA, 451 bp, Artificial; identical to SEQ ID NO: 2247
  TaSBEIIa-B allele with mutations introduced by TALEN pair TaSBEIIa_T03

SEQ ID NO: 2760 - DNA, 445 bp, Artificial; identical to SEQ ID NO: 2217
  TaSBEIIa-B allele with mutations introduced by TALEN pair TaSBEIIa_T03

SEQ ID NO: 2761 - DNA, 431 bp, Artificial
  TaSBEIIa-B allele with mutations introduced by TALEN pair TaSBEIIa_T03
  misc_feature (70); (111): n is a or c or t or g
gagatagctggattaggcgatcgcctcaaggccctggtgttatccacggctttgatcatctcctcctttncatgctgatattttctcactctttcttctgttcttgcagtntaactgcaagttgtagcattttttggcaaataagttgtagcattgtctcagtattgtactcatccttgcatttgcaggcgccgtcctgagccgcgcggccttcctggtgcctgacggtgagagcgacgacttggcggccactccagcgcaaccgcagaataatcaaggtacacaccgtcgtgccggaaaatcttcatgcaaccgtcgtattcacttaccaaatatcggatgaaccaagccgcggaggcatcaggtttcaagctcttctatcagcattgtgcactacttcacatgccttgtgcagtttgttagctgtggcc

SEQ ID NO: 2762 - DNA, 452 bp, Artificial; identical to SEQ ID NO: 2202
  TaSBEIIa-B allele with mutations introduced by TALEN pair TaSBEIIa_T03

SEQ ID NO: 2763 - DNA, 452 bp, Artificial; identical to SEQ ID NO: 2202
  TaSBEIIa-B allele with mutations introduced by TALEN pair TaSBEIIa_T03

SEQ ID NO: 2764 - DNA, 439 bp, Artificial; identical to SEQ ID NO: 2508
  TaSBEIIa-B allele with mutations introduced by TALEN pair TaSBEIIa_T03

SEQ ID NO: 2765 - DNA, 453 bp, Artificial; identical to SEQ ID NO: 2283
  TaSBEIIa-B allele with mutations introduced by TALEN pair TaSBEIIa_T03

SEQ ID NO: 2766 - DNA, 431 bp, Artificial; identical to SEQ ID NO: 2209
  TaSBEIIa-B allele with mutations introduced by TALEN pair TaSBEIIa_T03

SEQ ID NO: 2767 - DNA, 452 bp, Artificial; identical to SEQ ID NO: 2202
  TaSBEIIa-B allele with mutations introduced by TALEN pair TaSBEIIa_T03

SEQ ID NO: 2768 - DNA, 453 bp, Artificial; identical to SEQ ID NO: 2283
  TaSBEIIa-B allele with mutations introduced by TALEN pair TaSBEIIa_T03

SEQ ID NO: 2769 - DNA, 452 bp, Artificial; identical to SEQ ID NO: 2202
  TaSBEIIa-B allele with mutations introduced by TALEN pair TaSBEIIa_T03

SEQ ID NO: 2770 - DNA, 436 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcgtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2771 - DNA, 436 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggccttcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctc

SEQ ID NO: 2772 - DNA, 452 bp, Artificial; identical to SEQ ID NO: 2202
  TaSBEIIa-B allele with mutations introduced by TALEN pair TaSBEIIa_T03

SEQ ID NO: 2773 - DNA, 451 bp, Artificial; identical to SEQ ID NO: 2247
  TaSBEIIa-B allele with mutations introduced by TALEN pair TaSBEIIa_T03

SEQ ID NO: 2774 - DNA, 445 bp, Artificial; identical to SEQ ID NO: 2217
  TaSBEIIa-B allele with mutations introduced by TALEN pair TaSBEIIa_T03

SEQ ID NO: 2775 - DNA, 439 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcagcgccgctcctgcagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgc

SEQ ID NO: 2776 - DNA, 451 bp, Artificial; identical to SEQ ID NO: 2247
  TaSBEIIa-B allele with mutations introduced by TALEN pair TaSBEIIa_T03

SEQ ID NO: 2777 - DNA, 507 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2778 - DNA, 503 bp, Artificial; identical to SEQ ID NO: 2271
  TaSBEIIa-B allele with mutations introduced by TALEN pair TaSBEIIa_T03

SEQ ID NO: 2779 - DNA, 508 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaatcttcatgcaccccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2780 - DNA, 445 bp, Artificial; identical to SEQ ID NO: 2217
  TaSBEIIa-B allele with mutations introduced by TALEN pair TaSBEIIa_T03

SEQ ID NO: 2781 - DNA, 535 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagcgtttctgggtgagcaaaaacaggaaggcaaaatgccgcaaaaaagggaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactgaactgagaccgccaaggcacacaggggata

SEQ ID NO: 2782 - DNA, 452 bp, Artificial; identical to SEQ ID NO: 2202
  TaSBEIIa-B allele with mutations introduced by TALEN pair TaSBEIIa_T03

SEQ ID NO: 2783 - DNA, 439 bp, Artificial; identical to SEQ ID NO: 2508
  TaSBEIIa-B allele with mutations introduced by TALEN pair TaSBEIIa_T03

SEQ ID NO: 2784 - DNA, 443 bp, Artificial; identical to SEQ ID NO: 2624
  TaSBEIIa-B allele with mutations introduced by TALEN pair TaSBEIIa_T03

SEQ ID NO: 2785 - DNA, 452 bp, Artificial; identical to SEQ ID NO: 2202
  TaSBEIIa-B allele with mutations introduced by TALEN pair TaSBEIIa_T03

SEQ ID NO: 2786 - DNA, 503 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtatgcatttttggcaaataagttgtagcattgtctcagtattgtactcatccttgcatttgcaggcgccgtcctgagccgcgcggcctctccagcgtttctgggtgagcaaaaacaggaaggcaaaatgccgcaaaaagggaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2787 - DNA, 437 bp, Artificial; identical to SEQ ID NO: 2206
  TaSBEIIa-B allele with mutations introduced by TALEN pair TaSBEIIa_T03

SEQ ID NO: 2788 - DNA, 444 bp, Artificial; identical to SEQ ID NO: 2303
  TaSBEIIa-B allele with mutations introduced by TALEN pair TaSBEIIa_T03

SEQ ID NO: 2789 - DNA, 439 bp, Artificial; identical to SEQ ID NO: 2508
  TaSBEIIa-B allele with mutations introduced by TALEN pair TaSBEIIa_T03

SEQ ID NO: 2790 - DNA, 431 bp, Artificial
  TaSBEIIa-B allele with mutations introduced by TALEN pair TaSBEIIa_T03
gagatagctggattaggcgatcgcctcaggcccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgactttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2791 - DNA, 445 bp, Artificial; identical to SEQ ID NO: 2217
  TaSBEIIa-B allele with mutations introduced by TALEN pair TaSBEIIa_T03

SEQ ID NO: 2792 - DNA, 451 bp, Artificial; identical to SEQ ID NO: 2247
  TaSBEIIa-B allele with mutations introduced by TALEN pair TaSBEIIa_T03

SEQ ID NO: 2793 - DNA, 453 bp, Artificial; identical to SEQ ID NO: 2283
  TaSBEIIa-B allele with mutations introduced by TALEN pair TaSBEIIa_T03

SEQ ID NO: 2794 - DNA, 452 bp, Artificial; identical to SEQ ID NO: 2202
  TaSBEIIa-B allele with mutations introduced by TALEN pair TaSBEIIa_T03

SEQ ID NO: 2795 - DNA, 511 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagggcgagcggtatcagctcactcaaaggcggtaatacggttatccacagaatcaggggaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcc

SEQ ID NO: 2796 - DNA, 452 bp, Artificial; identical to SEQ ID NO: 2202
  TaSBEIIa-B allele with mutations introduced by TALEN pair TaSBEIIa_T03

SEQ ID NO: 2797 - DNA, 453 bp, Artificial; identical to SEQ ID NO: 2569
  TaSBEIIa-B allele with mutations introduced by TALEN pair TaSBEIIa_T03

SEQ ID NO: 2798 - DNA, 443 bp, Artificial; identical to SEQ ID NO: 2624
  TaSBEIIa-B allele with mutations introduced by TALEN pair TaSBEIIa_T03

SEQ ID NO: 2799 - DNA, 452 bp, Artificial; identical to SEQ ID NO: 2202
  TaSBEIIa-B allele with mutations introduced by TALEN pair TaSBEIIa_T03

SEQ ID NO: 2800 - DNA, 600 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcgggcgaaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2801 - DNA, 439 bp, Artificial; identical to SEQ ID NO: 2508
  TaSBEIIa-B allele with mutations introduced by TALEN pair TaSBEIIa_T03

SEQ ID NO: 2802 - DNA, 452 bp, Artificial; identical to SEQ ID NO: 2202
  TaSBEIIa-B allele with mutations introduced by TALEN pair TaSBEIIa_T03

SEQ ID NO: 2803 - DNA, 585 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcggggcgaaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2804 - DNA, 453 bp, Artificial; identical to SEQ ID NO: 2283
  TaSBEIIa-B allele with mutations introduced by TALEN pair TaSBEIIa_T03

SEQ ID NO: 2805 - DNA, 428 bp, Artificial; identical to SEQ ID NO: 2268
  TaSBEIIa-B allele with mutations introduced by TALEN pair TaSBEIIa_T03

SEQ ID NO: 2806 - DNA, 510 bp, Artificial; identical to SEQ ID NO: 2277
  TaSBEIIa-B allele with mutations introduced by TALEN pair TaSBEIIa_T03

SEQ ID NO: 2807 - DNA, 513 bp, Artificial
  TaSBEIIa-B allele with mutations introduced by TALEN pair TaSBEIIa_T03
  misc_feature (493): n is a or c or t or g
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcaggtattgtactcatccttgcatttgcaggcgccgtcctgagccgcgcggcctctccagggcgagcggtatcagctcactcaaaggcggtaatacggttatccacagaatcagggaaggtcctggtgcctgacggtgagagcgacgacttggcggccactccagcgcaaccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccncgctggctcttgggccactg

SEQ ID NO: 2808 - DNA, 444 bp, Artificial; identical to SEQ ID NO: 2264
  TaSBEIIa-B allele with mutations introduced by TALEN pair TaSBEIIa_T03

SEQ ID NO: 2809 - DNA, 453 bp, Artificial; identical to SEQ ID NO: 2283
  TaSBEIIa-B allele with mutations introduced by TALEN pair TaSBEIIa_T03

SEQ ID NO: 2810 - DNA, 514 bp, Artificial; identical to SEQ ID NO: 2395
  TaSBEIIa-B allele with mutations introduced by TALEN pair TaSBEIIa_T03

SEQ ID NO: 2811 - DNA, 452 bp, Artificial; identical to SEQ ID NO: 2202
  TaSBEIIa-B allele with mutations introduced by TALEN pair TaSBEIIa_T03

SEQ ID NO: 2812 - DNA, 428 bp, Artificial
  TaSBEIIa-B allele with mutations introduced by TALEN pair TaSBEIIa_T03
gagatagctggattaggcgatcgcctcaggccctgtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggttttcaagcttcttctatcagcattgtgcactacttcactgccttgtgcagtttgttagctgtggccccg

SEQ ID NO: 2813 - DNA, 451 bp, Artificial; identical to SEQ ID NO: 2247
  TaSBEIIa-B allele with mutations introduced by TALEN pair TaSBEIIa_T03

SEQ ID NO: 2814 - DNA, 601 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcggggcgaaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2815 - DNA, 452 bp, Artificial; identical to SEQ ID NO: 2202
  TaSBEIIa-B allele with mutations introduced by TALEN pair TaSBEIIa_T03

SEQ ID NO: 2816 - DNA, 452 bp, Artificial; identical to SEQ ID NO: 2202
  TaSBEIIa-B allele with mutations introduced by TALEN pair TaSBEIIa_T03

SEQ ID NO: 2817 - DNA, 502 bp, Artificial; identical to SEQ ID NO: 2372
  TaSBEIIa-B allele with mutations introduced by TALEN pair TaSBEIIa_T03

SEQ ID NO: 2818 - DNA, 452 bp, Artificial; identical to SEQ ID NO: 2371
  TaSBEIIa-B allele with mutations introduced by TALEN pair TaSBEIIa_T03

SEQ ID NO: 2819 - DNA, 511 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccatacaggggcaagcacctgggcggctccaggaagcccgacggcgccatctacaccaaggctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2820 - DNA, 448 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttacaatatcggatgaaccaagccgcggaggcatcaggttcaagcttctctatcagcattgtgcactacttcactgccttgtgcagtttgttagctgtggccccgcgctggctcttgggcca

SEQ ID NO: 2821 - DNA, 515 bp, Artificial; identical to SEQ ID NO: 2379
  TaSBEIIa-B allele with mutations introduced by TALEN pair TaSBEIIa_T03

SEQ ID NO: 2822 - DNA, 452 bp, Artificial; identical to SEQ ID NO: 2202
  TaSBEIIa-B allele with mutations introduced by TALEN pair TaSBEIIa_T03

SEQ ID NO: 2823 - DNA, 445 bp, Artificial; identical to SEQ ID NO: 2217
  TaSBEIIa-B allele with mutations introduced by TALEN pair TaSBEIIa_T03

SEQ ID NO: 2824 - DNA, 450 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcaacccgttattcacttaccaaatatcggatgaaccaagccgcggaggcatcaggtttcaagctcttctatcagcattgtgcactacttcactgccttgtgcagtttgttagctgtggccccgcgctggctcttgggcc

SEQ ID NO: 2825 - DNA, 452 bp, Artificial; identical to SEQ ID NO: 2202
  TaSBEIIa-B allele with mutations introduced by TALEN pair TaSBEIIa_T03

SEQ ID NO: 2826 - DNA, 439 bp, Artificial; identical to SEQ ID NO: 2508
  TaSBEIIa-B allele with mutations introduced by TALEN pair TaSBEIIa_T03

SEQ ID NO: 2827 - DNA, 452 bp, Artificial; identical to SEQ ID NO: 2202
  TaSBEIIa-B allele with mutations introduced by TALEN pair TaSBEIIa_T03

SEQ ID NO: 2828 - DNA, 493 bp, Artificial; identical to SEQ ID NO: 2310
  TaSBEIIa-B allele with mutations introduced by TALEN pair TaSBEIIa_T03

SEQ ID NO: 2829 - DNA, 445 bp, Artificial; identical to SEQ ID NO: 2729
  TaSBEIIa-B allele with mutations introduced by TALEN pair TaSBEIIa_T03

SEQ ID NO: 2830 - DNA, 452 bp, Artificial; identical to SEQ ID NO: 2202
  TaSBEIIa-B allele with mutations introduced by TALEN pair TaSBEIIa_T03

SEQ ID NO: 2831 - DNA, 445 bp, Artificial; identical to SEQ ID NO: 2217
  TaSBEIIa-B allele with mutations introduced by TALEN pair TaSBEIIa_T03

SEQ ID NO: 2832 - DNA, 449 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggttttgagcttcttctatcagcattgtgcagtactgcactgccttgtgcattttgttagccgtggccccgtgctggctcttgggccactgaa

SEQ ID NO: 2833 - DNA, 445 bp, Artificial; identical to SEQ ID NO: 2217
  TaSBEIIa-B allele with mutations introduced by TALEN pair TaSBEIIa_T03

SEQ ID NO: 2834 - DNA, 444 bp, Artificial; identical to SEQ ID NO: 2264
  TaSBEIIa-B allele with mutations introduced by TALEN pair TaSBEIIa_T03

SEQ ID NO: 2835 - DNA, 452 bp, Artificial; identical to SEQ ID NO: 2202
  TaSBEIIa-B allele with mutations introduced by TALEN pair TaSBEIIa_T03

SEQ ID NO: 2836 - DNA, 508 bp, Artificial; identical to SEQ ID NO: 2282
  TaSBEIIa-B allele with mutations introduced by TALEN pair TaSBEIIa_T03

SEQ ID NO: 2837 - DNA, 453 bp, Artificial; identical to SEQ ID NO: 2283
  TaSBEIIa-B allele with mutations introduced by TALEN pair TaSBEIIa_T03

SEQ ID NO: 2838 - DNA, 510 bp, Artificial; identical to SEQ ID NO: 2277
  TaSBEIIa-B allele with mutations introduced by TALEN pair TaSBEIIa_T03

SEQ ID NO: 2839 - DNA, 451 bp, Artificial; identical to SEQ ID NO: 2247
  TaSBEIIa-B allele with mutations introduced by TALEN pair TaSBEIIa_T03

SEQ ID NO: 2840 - DNA, 452 bp, Artificial; identical to SEQ ID NO: 2202
  TaSBEIIa-B allele with mutations introduced by TALEN pair TaSBEIIa_T03

SEQ ID NO: 2841 - DNA, 443 bp, Artificial; identical to SEQ ID NO: 2624
  TaSBEIIa-B allele with mutations introduced by TALEN pair TaSBEIIa_T03

SEQ ID NO: 2842 - DNA, 444 bp, Artificial; identical to SEQ ID NO: 2264
  TaSBEIIa-B allele with mutations introduced by TALEN pair TaSBEIIa_T03

SEQ ID NO: 2843 - DNA, 446 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtggagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2844 - DNA, 439 bp, Artificial; identical to SEQ ID NO: 2508
  TaSBEIIa-B allele with mutations introduced by TALEN pair TaSBEIIa_T03

SEQ ID NO: 2845 - DNA, 447 bp, Artificial
  TaSBEIIa-B allele with mutations introduced by TALEN pair TaSBEIIa_T03
gagatagctggattaggcgatcgcccacaggcccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2846 - DNA, 453 bp, Artificial; identical to SEQ ID NO: 2283
  TaSBEIIa-B allele with mutations introduced by TALEN pair TaSBEIIa_T03

SEQ ID NO: 2847 - DNA, 437 bp, Artificial; identical to SEQ ID NO: 2434
  TaSBEIIa-B allele with mutations introduced by TALEN pair TaSBEIIa_T03

SEQ ID NO: 2848 - DNA, 452 bp, Artificial
  TaSBEIIa-B allele with mutations introduced by TALEN pair TaSBEIIa_T03
gagatagctggattaggcgatcgcctcaggccctggtgttaccacgactttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2849 - DNA, 446 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2850 - DNA, 452 bp, Artificial; identical to SEQ ID NO: 2202
  TaSBEIIa-B allele with mutations introduced by TALEN pair TaSBEIIa_T03

SEQ ID NO: 2851 - DNA, 505 bp, Artificial; identical to SEQ ID NO: 2365
  TaSBEIIa-B allele with mutations introduced by TALEN pair TaSBEIIa_T03

SEQ ID NO: 2852 - DNA, 452 bp, Artificial; identical to SEQ ID NO: 2202
  TaSBEIIa-B allele with mutations introduced by TALEN pair TaSBEIIa_T03

SEQ ID NO: 2853 - DNA, 453 bp, Artificial; identical to SEQ ID NO: 2283
  TaSBEIIa-B allele with mutations introduced by TALEN pair TaSBEIIa_T03

SEQ ID NO: 2854 - DNA, 569 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaacgttcttcggggcgaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcag

SEQ ID NO: 2855 - DNA, 453 bp, Artificial; identical to SEQ ID NO: 2283
  TaSBEIIa-B allele with mutations introduced by TALEN pair TaSBEIIa_T03

SEQ ID NO: 2856 - DNA, 447 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagtgctgctcgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2857 - DNA, 431 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2858 - DNA, 505 bp, Artificial; identical to SEQ ID NO: 2365
  TaSBEIIa-B allele with mutations introduced by TALEN pair TaSBEIIa_T03

SEQ ID NO: 2859 - DNA, 444 bp, Artificial; identical to SEQ ID NO: 2264
  TaSBEIIa-B allele with mutations introduced by TALEN pair TaSBEIIa_T03

SEQ ID NO: 2860 - DNA, 445 bp, Artificial; identical to SEQ ID NO: 2217
  TaSBEIIa-B allele with mutations introduced by TALEN pair TaSBEIIa_T03

SEQ ID NO: 2861 - DNA, 431 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2862 - DNA, 470 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaatcttcatgcaccccgttattcacttaccaaaatatcggatgaaccaagccgcggaggcatcaggtttcaagcttcttctatcagcattgtgcactacttcactgccttgtgcag

SEQ ID NO: 2863 - DNA, 452 bp, Artificial; identical to SEQ ID NO: 2202
  TaSBEIIa-B allele with mutations introduced by TALEN pair TaSBEIIa_T03

SEQ ID NO: 2864 - DNA, 443 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccggttattcacttaccaaatatcggatgaaccaagccgcggaggcatcaggtttcaagcttcttctatcagcattgtgcactacttcactgccttgtgcagtttgttagctgtggccccgcgctggc

SEQ ID NO: 2865 - DNA, 441 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggc

SEQ ID NO: 2866 - DNA, 451 bp, Artificial; identical to SEQ ID NO: 2247
  TaSBEIIa-B allele with mutations introduced by TALEN pair TaSBEIIa_T03

SEQ ID NO: 2867 - DNA, 452 bp, Artificial; identical to SEQ ID NO: 2202
  TaSBEIIa-B allele with mutations introduced by TALEN pair TaSBEIIa_T03

SEQ ID NO: 2868 - DNA, 444 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctcgtgcctgacggtgagagcgacgacttggcggccactccagcgcaacccgaagaattacaggtacacaccgtcgatgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2869 - DNA, 505 bp, Artificial; identical to SEQ ID NO: 2365
  TaSBEIIa-B allele with mutations introduced by TALEN pair TaSBEIIa_T03

SEQ ID NO: 2870 - DNA, 445 bp, Artificial; identical to SEQ ID NO: 2217
  TaSBEIIa-B allele with mutations introduced by TALEN pair TaSBEIIa_T03

SEQ ID NO: 2871 - DNA, 437 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctcgtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2872 - DNA, 453 bp, Artificial; identical to SEQ ID NO: 2283
  TaSBEIIa-B allele with mutations introduced by TALEN pair TaSBEIIa_T03

SEQ ID NO: 2873 - DNA, 452 bp, Artificial; identical to SEQ ID NO: 2202
  TaSBEIIa-B allele with mutations introduced by TALEN pair TaSBEIIa_T03

SEQ ID NO: 2874 - DNA, 452 bp, Artificial; identical to SEQ ID NO: 2202
  TaSBEIIa-B allele with mutations introduced by TALEN pair TaSBEIIa_T03

SEQ ID NO: 2875 - DNA, 426 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccc

SEQ ID NO: 2876 - DNA, 452 bp, Artificial; identical to SEQ ID NO: 2202
  TaSBEIIa-B allele with mutations introduced by TALEN pair TaSBEIIa_T03

SEQ ID NO: 2877 - DNA, 451 bp, Artificial; identical to SEQ ID NO: 2247
  TaSBEIIa-B allele with mutations introduced by TALEN pair TaSBEIIa_T03

SEQ ID NO: 2878 - DNA, 444 bp, Artificial; identical to SEQ ID NO: 2303
  TaSBEIIa-B allele with mutations introduced by TALEN pair TaSBEIIa_T03

SEQ ID NO: 2879 - DNA, 446 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcgggatgaaccaagccgcggaggcatcaggtttcaagcttcttctatcagcattgtgcactacttcactgccttgtgcagtttgttagctgtggccccgcgctggctcttgggcca

SEQ ID NO: 2880 - DNA, 493 bp, Artificial; identical to SEQ ID NO: 2310
  TaSBEIIa-B allele with mutations introduced by TALEN pair TaSBEIIa_T03

SEQ ID NO: 2881 - DNA, 439 bp, Artificial; identical to SEQ ID NO: 2508
  TaSBEIIa-B allele with mutations introduced by TALEN pair TaSBEIIa_T03

SEQ ID NO: 2882 - DNA, 452 bp, Artificial; identical to SEQ ID NO: 2202
  TaSBEIIa-B allele with mutations introduced by TALEN pair TaSBEIIa_T03

SEQ ID NO: 2883 - DNA, 610 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcggggcgaaactctcaaggatcttaatcagtgaggcacctatctcagcgatctgtctattttgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttggggccactg

SEQ ID NO: 2884 - DNA, 423 bp, Artificial; identical to SEQ ID NO: 2733
  TaSBEIIa-B allele with mutations introduced by TALEN pair TaSBEIIa_T03

SEQ ID NO: 2885 - DNA, 453 bp, Artificial; identical to SEQ ID NO: 2283
  TaSBEIIa-B allele with mutations introduced by TALEN pair TaSBEIIa_T03

SEQ ID NO: 2886 - DNA, 444 bp, Artificial; identical to SEQ ID NO: 2303
  TaSBEIIa-B allele with mutations introduced by TALEN pair TaSBEIIa_T03

SEQ ID NO: 2887 - DNA, 452 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggccctctcaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2888 - DNA, 452 bp, Artificial; identical to SEQ ID NO: 2436
  TaSBEIIa-B allele with mutations introduced by TALEN pair TaSBEIIa_T03

SEQ ID NO: 2889 - DNA, 445 bp, Artificial; identical to SEQ ID NO: 2217
  TaSBEIIa-B allele with mutations introduced by TALEN pair TaSBEIIa_T03

SEQ ID NO: 2890 - DNA, 422 bp, Artificial; identical to SEQ ID NO: 2750
  TaSBEIIa-B allele with mutations introduced by TALEN pair TaSBEIIa_T03

SEQ ID NO: 2891 - DNA, 494 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagacagtaagagaattatgcagtgctgccataaccatgaaggtcctggtgcctgacggtgagagcgacgacttggcggccactccagcgcaacccgaagaattacaggtacacaccgtcgtgccggaaaatcttcatgcacccgttattcacttacccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2892 - DNA, 439 bp, Artificial; identical to SEQ ID NO: 2508
  TaSBEIIa-B allele with mutations introduced by TALEN pair TaSBEIIa_T03

SEQ ID NO: 2893 - DNA, 452 bp, Artificial; identical to SEQ ID NO: 2202
  TaSBEIIa-B allele with mutations introduced by TALEN pair TaSBEIIa_T03

SEQ ID NO: 2894 - DNA, 453 bp, Artificial; identical to SEQ ID NO: 2283
  TaSBEIIa-B allele with mutations introduced by TALEN pair TaSBEIIa_T03

SEQ ID NO: 2895 - DNA, 508 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaatcttcatgcaccccgttattcacttaccaaaatatcggatgaaccaagccgcggaggcatcaggtttcaagcttcttctatcagcattgtgcactacttcactgccttgtgcagttgttagctgtggccccgcgctggctcttgggccactg

SEQ ID NO: 2896 - DNA, 444 bp, Artificial; identical to SEQ ID NO: 2303
  TaSBEIIa-B allele with mutations introduced by TALEN pair TaSBEIIa_T03

SEQ ID NO: 2897 - DNA, 452 bp, Artificial; identical to SEQ ID NO: 2202
  TaSBEIIa-B allele with mutations introduced by TALEN pair TaSBEIIa_T03

SEQ ID NO: 2898 - DNA, 452 bp, Artificial; identical to SEQ ID NO: 2202
  TaSBEIIa-B allele with mutations introduced by TALEN pair TaSBEIIa_T03

SEQ ID NO: 2899 - DNA, 445 bp, Artificial; identical to SEQ ID NO: 2217
  TaSBEIIa-B allele with mutations introduced by TALEN pair TaSBEIIa_T03

SEQ ID NO: 2900 - DNA, 451 bp, Artificial; identical to SEQ ID NO: 2247
  TaSBEIIa-B allele with mutations introduced by TALEN pair TaSBEIIa_T03

SEQ ID NO: 2901 - DNA, 445 bp, Artificial; identical to SEQ ID NO: 2217
  TaSBEIIa-B allele with mutations introduced by TALEN pair TaSBEIIa_T03

SEQ ID NO: 2902 - DNA, 444 bp, Artificial; identical to SEQ ID NO: 2303
  TaSBEIIa-B allele with mutations introduced by TALEN pair TaSBEIIa_T03

SEQ ID NO: 2903 - DNA, 452 bp, Artificial; identical to SEQ ID NO: 2202
  TaSBEIIa-B allele with mutations introduced by TALEN pair TaSBEIIa_T03

SEQ ID NO: 2904 - DNA, 451 bp, Artificial; identical to SEQ ID NO: 2247
  TaSBEIIa-B allele with mutations introduced by TALEN pair TaSBEIIa_T03

SEQ ID NO: 2905 - DNA, 452 bp, Artificial; identical to SEQ ID NO: 2202
  TaSBEIIa-B allele with mutations introduced by TALEN pair TaSBEIIa_T03

SEQ ID NO: 2906 - DNA, 453 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccggttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2907 - DNA, 432 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcgtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggc

SEQ ID NO: 2908 - DNA, 451 bp, Artificial; identical to SEQ ID NO: 2247
  TaSBEIIa-B allele with mutations introduced by TALEN pair TaSBEIIa_T03

SEQ ID NO: 2909 - DNA, 453 bp, Artificial; identical to SEQ ID NO: 2283
  TaSBEIIa-B allele with mutations introduced by TALEN pair TaSBEIIa_T03

SEQ ID NO: 2910 - DNA, 452 bp, Artificial; identical to SEQ ID NO: 2202
  TaSBEIIa-B allele with mutations introduced by TALEN pair TaSBEIIa_T03

SEQ ID NO: 2911 - DNA, 441 bp, Artificial; identical to SEQ ID NO: 2359
  TaSBEIIa-B allele with mutations introduced by TALEN pair TaSBEIIa_T03

SEQ ID NO: 2912 - DNA, 429 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 2913 - DNA, 453 bp, Artificial; identical to SEQ ID NO: 2283
  TaSBEIIa-B allele with mutations introduced by TALEN pair TaSBEIIa_T03

SEQ ID NO: 2914 - DNA, 452 bp, Artificial; identical to SEQ ID NO: 2202
  TaSBEIIa-B allele with mutations introduced by TALEN pair TaSBEIIa_T03

SEQ ID NO: 2915 - DNA, 439 bp, Artificial; identical to SEQ ID NO: 2508
  TaSBEIIa-B allele with mutations introduced by TALEN pair TaSBEIIa_T03

SEQ ID NO: 2916 - DNA, 452 bp, Artificial; identical to SEQ ID NO: 2202
  TaSBEIIa-B allele with mutations introduced by TALEN pair TaSBEIIa_T03

SEQ ID NO: 2917 - DNA, 451 bp, Artificial; identical to SEQ ID NO: 2247
  TaSBEIIa-B allele with mutations introduced by TALEN pair TaSBEIIa_T03

SEQ ID NO: 2918 - DNA, 452 bp, Artificial; identical to SEQ ID NO: 2202
  TaSBEIIa-B allele with mutations introduced by TALEN pair TaSBEIIa_T03

SEQ ID NO: 2919 - DNA, 451 bp, Artificial; identical to SEQ ID NO: 2247
  TaSBEIIa-B allele with mutations introduced by TALEN pair TaSBEIIa_T03

SEQ ID NO: 2920 - DNA, 452 bp, Artificial; identical to SEQ ID NO: 2202
  TaSBEIIa-B allele with mutations introduced by TALEN pair TaSBEIIa_T03

SEQ ID NO: 2921 - DNA, 452 bp, Artificial; identical to SEQ ID NO: 2202
  TaSBEIIa-B allele with mutations introduced by TALEN pair TaSBEIIa_T03

SEQ ID NO: 2922 - DNA, 444 bp, Artificial; identical to SEQ ID NO: 2264
  TaSBEIIa-B allele with mutations introduced by TALEN pair TaSBEIIa_T03

SEQ ID NO: 2923 - DNA, 449 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggc

SEQ ID NO: 2924 - DNA, 451 bp, Artificial; identical to SEQ ID NO: 2247
  TaSBEIIa-B allele with mutations introduced by TALEN pair TaSBEIIa_T03

SEQ ID NO: 2925 - DNA, 451 bp, Artificial; identical to SEQ ID NO: 2247
  TaSBEIIa-B allele with mutations introduced by TALEN pair TaSBEIIa_T03

SEQ ID NO: 2926 - DNA, 451 bp, Artificial; identical to SEQ ID NO: 2247
  TaSBEIIa-B allele with mutations introduced by TALEN pair TaSBEIIa_T03

SEQ ID NO: 2927 - DNA, 452 bp, Artificial; identical to SEQ ID NO: 2202
  TaSBEIIa-B allele with mutations introduced by TALEN pair TaSBEIIa_T03

SEQ ID NO: 2928 - DNA, 430 bp, Artificial; identical to SEQ ID NO: 2455
  TaSBEIIa-B allele with mutations introduced by TALEN pair TaSBEIIa_T03

SEQ ID NO: 2929 - DNA, 452 bp, Artificial; identical to SEQ ID NO: 2202
  TaSBEIIa-B allele with mutations introduced by TALEN pair TaSBEIIa_T03

SEQ ID NO: 2930 - DNA, 445 bp, Artificial; identical to SEQ ID NO: 2217
  TaSBEIIa-B allele with mutations introduced by TALEN pair TaSBEIIa_T03

SEQ ID NO: 2931 - DNA, 494 bp, Artificial
  TaSBEIIa-B allele with mutations introduced by TALEN pair TaSBEIIa_T03
gagatagctggattaggcgatcgccatcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaaggtcctggtgcctgacggtgagagcgacgacttggcggccactccagcgcaacccgaagaattacaggtacacaccgtcgtgccggaaaaatcttcatgcaccccgttattcacttaccaaatatcggatgaaccaagccgcggaggcatcaggtttcaagcttcttctatcagcattgtgcactacttcactgcccttgtgcagttgttagctgtggccccgcgc

SEQ ID NO: 2932 - DNA, 451 bp, Artificial; identical to SEQ ID NO: 2247
  TaSBEIIa-B allele with mutations introduced by TALEN pair TaSBEIIa_T03

SEQ ID NO: 2933 - DNA, 439 bp, Artificial; identical to SEQ ID NO: 2508
  TaSBEIIa-B allele with mutations introduced by TALEN pair TaSBEIIa_T03

SEQ ID NO: 2934 - DNA, 452 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctattagcattgtgcactacttcactgccttgtgcagtttgttagctgtggccccgcgctggctcttgggcca

SEQ ID NO: 2935 - DNA, 452 bp, Artificial; identical to SEQ ID NO: 2202
  TaSBEIIa-B allele with mutations introduced by TALEN pair TaSBEIIa_T03

SEQ ID NO: 2936 - DNA, 509 bp, Artificial; identical to SEQ ID NO: 2708
  TaSBEIIa-B allele with mutations introduced by TALEN pair TaSBEIIa_T03

SEQ ID NO: 2937 - DNA, 438 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggccttcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 2938 - DNA, 507 bp, Artificial; identical to SEQ ID NO: 2777
  TaSBEIIa-B allele with mutations introduced by TALEN pair TaSBEIIa_T03

SEQ ID NO: 2939 - DNA, 451 bp, Artificial; identical to SEQ ID NO: 2247
  TaSBEIIa-B allele with mutations introduced by TALEN pair TaSBEIIa_T03

SEQ ID NO: 2940 - DNA, 452 bp, Artificial; identical to SEQ ID NO: 2202
  TaSBEIIa-B allele with mutations introduced by TALEN pair TaSBEIIa_T03

SEQ ID NO: 2941 - DNA, 445 bp, Artificial; identical to SEQ ID NO: 2217
  TaSBEIIa-B allele with mutations introduced by TALEN pair TaSBEIIa_T03

SEQ ID NO: 2942 - DNA, 439 bp, Artificial; identical to SEQ ID NO: 2508
  TaSBEIIa-B allele with mutations introduced by TALEN pair TaSBEIIa_T03

SEQ ID NO: 2943 - DNA, 585 bp, Artificial; identical to SEQ ID NO: 2803
  TaSBEIIa-B allele with mutations introduced by TALEN pair TaSBEIIa_T03

SEQ ID NO: 2944 - DNA, 452 bp, Artificial; identical to SEQ ID NO: 2202
  TaSBEIIa-B allele with mutations introduced by TALEN pair TaSBEIIa_T03

SEQ ID NO: 2945 - DNA, 601 bp, Artificial; identical to SEQ ID NO: 2814
  TaSBEIIa-B allele with mutations introduced by TALEN pair TaSBEIIa_T03

SEQ ID NO: 2946 - DNA, 445 bp, Artificial; identical to SEQ ID NO: 2217
  TaSBEIIa-B allele with mutations introduced by TALEN pair TaSBEIIa_T03

SEQ ID NO: 2947 - DNA, 439 bp, Artificial; identical to SEQ ID NO: 2508
  TaSBEIIa-B allele with mutations introduced by TALEN pair TaSBEIIa_T03

SEQ ID NO: 2948 - DNA, 505 bp, Artificial; identical to SEQ ID NO: 2365
  TaSBEIIa-B allele with mutations introduced by TALEN pair TaSBEIIa_T03

SEQ ID NO: 2949 - DNA, 452 bp, Artificial; identical to SEQ ID NO: 2202
  TaSBEIIa-B allele with mutations introduced by TALEN pair TaSBEIIa_T03

SEQ ID NO: 2950 - DNA, 435 bp, Artificial; identical to SEQ ID NO: 2199
  TaSBEIIa-B allele with mutations introduced by TALEN pair TaSBEIIa_T03

SEQ ID NO: 2951 - DNA, 610 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcggggcgaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttggggccactg

SEQ ID NO: 2952 - DNA, 515 bp, Artificial; identical to SEQ ID NO: 2379
  TaSBEIIa-B allele with mutations introduced by TALEN pair TaSBEIIa_T03

SEQ ID NO: 2953 - DNA, 444 bp, Artificial; identical to SEQ ID NO: 2264
  TaSBEIIa-B allele with mutations introduced by TALEN pair TaSBEIIa_T03

SEQ ID NO: 2954 - DNA, 493 bp, Artificial; identical to SEQ ID NO: 2310
  TaSBEIIa-B allele with mutations introduced by TALEN pair TaSBEIIa_T03

SEQ ID NO: 2955 - DNA, 453 bp, Artificial; identical to SEQ ID NO: 2283
  TaSBEIIa-B allele with mutations introduced by TALEN pair TaSBEIIa_T03

SEQ ID NO: 2956 - DNA, 498 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagggcgagcggtatcagctcactcaaaggcggtaatacggttatccacagaatcagggaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgct

SEQ ID NO: 2957 - DNA, 451 bp, Artificial; identical to SEQ ID NO: 2247
  TaSBEIIa-B allele with mutations introduced by TALEN pair TaSBEIIa_T03

SEQ ID NO: 2958 - DNA, 452 bp, Artificial; identical to SEQ ID NO: 2202
  TaSBEIIa-B allele with mutations introduced by TALEN pair TaSBEIIa_T03

SEQ ID NO: 2959 - DNA, 439 bp, Artificial; identical to SEQ ID NO: 2508
  TaSBEIIa-B allele with mutations introduced by TALEN pair TaSBEIIa_T03

SEQ ID NO: 2960 - DNA, 434 bp, Artificial; identical to SEQ ID NO: 2539
  TaSBEIIa-B allele with mutations introduced by TALEN pair TaSBEIIa_T03

SEQ ID NO: 2961 - DNA, 710 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggttttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggct

SEQ ID NO: 2962 - DNA, 511 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaacttgcaagttgtagcatttttttggcaaataagttgtagcattgtctcagtattgtactcatccttgcatttgcaggcgccgtcctgagccgcgcggcctctccatacaggggcaagcacctgggcggctccaggaagcccgacggcgccatctacaccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 2963 - DNA, 446 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccgtgctgctcgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2964 - DNA, 445 bp, Artificial; identical to SEQ ID NO: 2217
  TaSBEIIa-B allele with mutations introduced by TALEN pair TaSBEIIa_T03

SEQ ID NO: 2965 - DNA, 439 bp, Artificial; identical to SEQ ID NO: 2508
  TaSBEIIa-B allele with mutations introduced by TALEN pair TaSBEIIa_T03

SEQ ID NO: 2966 - DNA, 453 bp, Artificial; identical to SEQ ID NO: 2283
  TaSBEIIa-B allele with mutations introduced by TALEN pair TaSBEIIa_T03

SEQ ID NO: 2967 - DNA, 451 bp, Artificial; identical to SEQ ID NO: 2247
  TaSBEIIa-B allele with mutations introduced by TALEN pair TaSBEIIa_T03

SEQ ID NO: 2968 - DNA, 452 bp, Artificial
  TaSBEIIa-B allele with mutations introduced by TALEN pair TaSBEIIa_T03
  misc_feature (109): n is a or c or t or g
gagatagctggattaggcgatcgcctcaggccctggtgttaccacggctttgatcatctcctcctttcatgctgatattttctcactctttcttctgttcttgctgtantcgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2969 - DNA, 452 bp, Artificial; identical to SEQ ID NO: 2202
  TaSBEIIa-B allele with mutations introduced by TALEN pair TaSBEIIa_T03

SEQ ID NO: 2970 - DNA, 451 bp, Artificial; identical to SEQ ID NO: 2247
  TaSBEIIa-B allele with mutations introduced by TALEN pair TaSBEIIa_T03

SEQ ID NO: 2971 - DNA, 445 bp, Artificial; identical to SEQ ID NO: 2217
  TaSBEIIa-B allele with mutations introduced by TALEN pair TaSBEIIa_T03

SEQ ID NO: 2972 - DNA, 452 bp, Artificial; identical to SEQ ID NO: 2202
  TaSBEIIa-B allele with mutations introduced by TALEN pair TaSBEIIa_T03

SEQ ID NO: 2973 - DNA, 444 bp, Artificial; identical to SEQ ID NO: 2228
  TaSBEIIa-B allele with mutations introduced by TALEN pair TaSBEIIa_T03

SEQ ID NO: 2974 - DNA, 453 bp, Artificial; identical to SEQ ID NO: 2283
  TaSBEIIa-B allele with mutations introduced by TALEN pair TaSBEIIa_T03

SEQ ID NO: 2975 - DNA, 452 bp, Artificial; identical to SEQ ID NO: 2202
  TaSBEIIa-B allele with mutations introduced by TALEN pair TaSBEIIa_T03

SEQ ID NO: 2976 - DNA, 515 bp, Artificial; identical to SEQ ID NO: 2379
  TaSBEIIa-B allele with mutations introduced by TALEN pair TaSBEIIa_T03

SEQ ID NO: 2977 - DNA, 452 bp, Artificial; identical to SEQ ID NO: 2202
  TaSBEIIa-B allele with mutations introduced by TALEN pair TaSBEIIa_T03

SEQ ID NO: 2978 - DNA, 710 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaacggagaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagttttgttagctgtggccccgcgctggctc

SEQ ID NO: 2979 - DNA, 451 bp, Artificial; identical to SEQ ID NO: 2247
  TaSBEIIa-B allele with mutations introduced by TALEN pair TaSBEIIa_T03

SEQ ID NO: 2980 - DNA, 446 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattggtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 2981 - DNA, 710 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaaatatcggatgaaccaagccgcggaggcatcaggtttcaagcttcttctatcagcattgtgcactacttcactgccttgtgcagtttgttagctgtggccccgcgctggctc

SEQ ID NO: 2982 - DNA, 439 bp, Artificial; identical to SEQ ID NO: 2508
  TaSBEIIa-B allele with mutations introduced by TALEN pair TaSBEIIa_T03

SEQ ID NO: 2983 - DNA, 451 bp, Artificial; identical to SEQ ID NO: 2247
  TaSBEIIa-B allele with mutations introduced by TALEN pair TaSBEIIa_T03

SEQ ID NO: 2984 - DNA, 599 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaatggagaaggtcctggtgcctgacggtgagagacgacgacttggcggccactccagcgcaacccgaagaattacaggtacacaccgtcgtgccggaaaatcttcatgcacccgttattcacttacc

SEQ ID NO: 2985 - DNA, 442 bp, Artificial; identical to SEQ ID NO: 2190
  TaSBEIIa-B allele with mutations introduced by TALEN pair TaSBEIIa_T03

SEQ ID NO: 2986 - DNA, 515 bp, Artificial; identical to SEQ ID NO: 2379
  TaSBEIIa-B allele with mutations introduced by TALEN pair TaSBEIIa_T03

SEQ ID NO: 2987 - DNA, 445 bp, Artificial; identical to SEQ ID NO: 2217
  TaSBEIIa-B allele with mutations introduced by TALEN pair TaSBEIIa_T03

SEQ ID NO: 2988 - DNA, 553 bp, Artificial
  TaSBEIIa-B allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggcccgcgctggctcttgggccact

SEQ ID NO: 2989 - DNA, 452 bp, Artificial; identical to SEQ ID NO: 2202
  TaSBEIIa-B allele with mutations introduced by TALEN pair TaSBEIIa_T03

SEQ ID NO: 2990 - DNA, 441 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgactggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcacattgtgcactacttcactgccttgtgcagtttgttagctgtggccccgcgctggct

SEQ ID NO: 2991 - DNA, 430 bp, Artificial; identical to SEQ ID NO: 2455
  TaSBEIIa-B allele with mutations introduced by TALEN pair TaSBEIIa_T03

SEQ ID NO: 2992 - DNA, 498 bp, Artificial; identical to SEQ ID NO: 2956
  TaSBEIIa-B allele with mutations introduced by TALEN pair TaSBEIIa_T03

SEQ ID NO: 2993 - DNA, 423 bp, Artificial; identical to SEQ ID NO: 2733
  TaSBEIIa-B allele with mutations introduced by TALEN pair TaSBEIIa_T03

SEQ ID NO: 2994 - DNA, 515 bp, Artificial; identical to SEQ ID NO: 2379
  TaSBEIIa-B allele with mutations introduced by TALEN pair TaSBEIIa_T03

SEQ ID NO: 2995 - DNA, 453 bp, Artificial; identical to SEQ ID NO: 2569
  TaSBEIIa-B allele with mutations introduced by TALEN pair TaSBEIIa_T03

SEQ ID NO: 2996 - DNA, 423 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctctggtgcctgacggtgagagcgacgacttggcggccactccagcgcaacccgaagaattacaggtacacaccgtcgtgccggaaaatcttcatgcacccgtttattcacttaccaaatatcgggatgaaccaagccgcggaggcatcaggtttcaagcttcttctatcagcattgtgcactacttcactgccttgtgcagtttgttagcgtgg

SEQ ID NO: 2997 - DNA, 452 bp, Artificial; identical to SEQ ID NO: 2202
  TaSBEIIa-B allele with mutations introduced by TALEN pair TaSBEIIa_T03

SEQ ID NO: 2998 - DNA, 445 bp, Artificial; identical to SEQ ID NO: 2217
  TaSBEIIa-B allele with mutations introduced by TALEN pair TaSBEIIa_T03

SEQ ID NO: 2999 - DNA, 454 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 3000 - DNA, 452 bp, Artificial; identical to SEQ ID NO: 2202
  TaSBEIIa-B allele with mutations introduced by TALEN pair TaSBEIIa_T03

SEQ ID NO: 3001 - DNA, 445 bp, Artificial; identical to SEQ ID NO: 2217
  TaSBEIIa-B allele with mutations introduced by TALEN pair TaSBEIIa_T03

SEQ ID NO: 3002 - DNA, 450 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 3003 - DNA, 452 bp, Artificial; identical to SEQ ID NO: 2202
  TaSBEIIa-B allele with mutations introduced by TALEN pair TaSBEIIa_T03

SEQ ID NO: 3004 - DNA, 452 bp, Artificial; identical to SEQ ID NO: 2202
  TaSBEIIa-B allele with mutations introduced by TALEN pair TaSBEIIa_T03

SEQ ID NO: 3005 - DNA, 452 bp, Artificial; identical to SEQ ID NO: 2202
  TaSBEIIa-B allele with mutations introduced by TALEN pair TaSBEIIa_T03

SEQ ID NO: 3006 - DNA, 423 bp, Artificial; identical to SEQ ID NO: 2733
  TaSBEIIa-B allele with mutations introduced by TALEN pair TaSBEIIa_T03

SEQ ID NO: 3007 - DNA, 439 bp, Artificial; identical to SEQ ID NO: 2508
  TaSBEIIa-B allele with mutations introduced by TALEN pair TaSBEIIa_T03

SEQ ID NO: 3008 - DNA, 445 bp, Artificial; identical to SEQ ID NO: 2217
  TaSBEIIa-B allele with mutations introduced by TALEN pair TaSBEIIa_T03

SEQ ID NO: 3009 - DNA, 452 bp, Artificial; identical to SEQ ID NO: 2202
  TaSBEIIa-B allele with mutations introduced by TALEN pair TaSBEIIa_T03

SEQ ID NO: 3010 - DNA, 423 bp, Artificial; identical to SEQ ID NO: 2733
  TaSBEIIa-B allele with mutations introduced by TALEN pair TaSBEIIa_T03

SEQ ID NO: 3011 - DNA, 504 bp, Artificial; identical to SEQ ID NO: 2514
  TaSBEIIa-B allele with mutations introduced by TALEN pair TaSBEIIa_T03

SEQ ID NO: 3012 - DNA, 453 bp, Artificial; identical to SEQ ID NO: 2316
  TaSBEIIa-B allele with mutations introduced by TALEN pair TaSBEIIa_T03

SEQ ID NO: 3013 - DNA, 494 bp, Artificial
  TaSBEIIa-B allele with mutations introduced by TALEN pair TaSBEIIa_T03
  misc_feature (491): n is a or c or t or g
gagatagctggattaggcgatcgcctcaggccctgtgttatccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaaccgaagaattacaggtacacaccgtcgtgccggaaaaatcttcatggcaccccgttattcactttaccaaaatatcggatgaaccaagccgcggaggcatcaggtttcaagcttccttctatcagcattgtgcactacttcactgccttgtgcagtttgttagctgtggcccncgc

SEQ ID NO: 3014 - DNA, 445 bp, Artificial; identical to SEQ ID NO: 2217
  TaSBEIIa-B allele with mutations introduced by TALEN pair TaSBEIIa_T03

SEQ ID NO: 3015 - DNA, 452 bp, Artificial; identical to SEQ ID NO: 2202
  TaSBEIIa-B allele with mutations introduced by TALEN pair TaSBEIIa_T03

SEQ ID NO: 3016 - DNA, 437 bp, Artificial; identical to SEQ ID NO: 2206
  TaSBEIIa-B allele with mutations introduced by TALEN pair TaSBEIIa_T03

SEQ ID NO: 3017 - DNA, 452 bp, Artificial; identical to SEQ ID NO: 2202
  TaSBEIIa-B allele with mutations introduced by TALEN pair TaSBEIIa_T03

SEQ ID NO: 3018 - DNA, 447 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccggttattcacttaccaaatatcggatgaaccaagccgcggaggcatcaggttttcaagcttcttctatcagcattgtgcactacttcactgccttgtgcagtttgttagctgtggccccgcgctggctcttgggcca

SEQ ID NO: 3019 - DNA, 452 bp, Artificial; identical to SEQ ID NO: 2202
  TaSBEIIa-B allele with mutations introduced by TALEN pair TaSBEIIa_T03

SEQ ID NO: 3020 - DNA, 435 bp, Artificial; identical to SEQ ID NO: 2199
  TaSBEIIa-B allele with mutations introduced by TALEN pair TaSBEIIa_T03

SEQ ID NO: 3021 - DNA, 447 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagtgctgcgcgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 3022 - DNA, 706 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcatgtgcactacttcactgccttgtgcagtttgttagctgtggccccgcgctggc

SEQ ID NO: 3023 - DNA, 452 bp, Artificial; identical to SEQ ID NO: 2202
  TaSBEIIa-B allele with mutations introduced by TALEN pair TaSBEIIa_T03

SEQ ID NO: 3024 - DNA, 515 bp, Artificial; identical to SEQ ID NO: 2379
  TaSBEIIa-B allele with mutations introduced by TALEN pair TaSBEIIa_T03

SEQ ID NO: 3025 - DNA, 451 bp, Artificial; identical to SEQ ID NO: 2247
  TaSBEIIa-B allele with mutations introduced by TALEN pair TaSBEIIa_T03

SEQ ID NO: 3026 - DNA, 447 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggcccccgcgctggctctt

SEQ ID NO: 3027 - DNA, 452 bp, Artificial; identical to SEQ ID NO: 2202
  TaSBEIIa-B allele with mutations introduced by TALEN pair TaSBEIIa_T03

SEQ ID NO: 3028 - DNA, 432 bp, Artificial
  TaSBEIIa-B allele with mutations introduced by TALEN pair TaSBEIIa_T03
gagatagctggattaggcgatcgcctcaggcctgctggcttgtccacggctttgatcatctcctcctttcatgctgatatttcttcactctttctttctgttcttgctgtaactgcaagttgtagcatttttttggcaaataagttgtagcattgtctcagtattgtactcatccttgcatttgcatggcgccgtcctgagccgcgcggccttcctggtgcctgacggtgagagcgacgacttggctggccagctcctagcgcaaccgcagaattgatcaggtacacaccgtcgtgccggaaaactcttcatgcaccgtctattcacttaccaaatatcggatgaaccaagccgcggaggcatcaggttttcaagcttcttctatcagcattgtgcactacttcactgccttgtgcagtttgttagctgtgg

SEQ ID NO: 3029 - DNA, 451 bp, Artificial; identical to SEQ ID NO: 2247
  TaSBEIIa-B allele with mutations introduced by TALEN pair TaSBEIIa_T03

SEQ ID NO: 3030 - DNA, 509 bp, Artificial; identical to SEQ ID NO: 2708
  TaSBEIIa-B allele with mutations introduced by TALEN pair TaSBEIIa_T03

SEQ ID NO: 3031 - DNA, 441 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagttgttagctgtggccccgcgctggc

SEQ ID NO: 3032 - DNA, 441 bp, Artificial; identical to SEQ ID NO: 2865
  TaSBEIIa-B allele with mutations introduced by TALEN pair TaSBEIIa_T03

SEQ ID NO: 3033 - DNA, 715 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcgctacagccagcagcaacaggagagatcaacgaggtcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 3034 - DNA, 430 bp, Artificial; identical to SEQ ID NO: 2455
  TaSBEIIa-B allele with mutations introduced by TALEN pair TaSBEIIa_T03

SEQ ID NO: 3035 - DNA, 452 bp, Artificial; identical to SEQ ID NO: 2202
  TaSBEIIa-B allele with mutations introduced by TALEN pair TaSBEIIa_T03

SEQ ID NO: 3036 - DNA, 494 bp, Artificial
  TaSBEIIa-B allele with mutations introduced by TALEN pair TaSBEIIa_T03
gagatagctggattaggcgatcgcctcaggccctggtgttaccacggctttgatcatcctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagacagtaagagaattatgcagtgctgccataaccatgaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 3037 - DNA, 493 bp, Artificial; identical to SEQ ID NO: 2310
  TaSBEIIa-B allele with mutations introduced by TALEN pair TaSBEIIa_T03

SEQ ID NO: 3038 - DNA, 437 bp, Artificial; identical to SEQ ID NO: 2434
  TaSBEIIa-B allele with mutations introduced by TALEN pair TaSBEIIa_T03

SEQ ID NO: 3039 - DNA, 452 bp, Artificial; identical to SEQ ID NO: 2202
  TaSBEIIa-B allele with mutations introduced by TALEN pair TaSBEIIa_T03

SEQ ID NO: 3040 - DNA, 516 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagggcgagcggtatcagctcactcaaaggcggtaatacggttatccacagaatcaggggaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgcccttgtgcagtttgttagctgtggccccgcgctggctcttgggccactg

SEQ ID NO: 3041 - DNA, 708 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggct

SEQ ID NO: 3042 - DNA, 707 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttctttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagcccggaagcataaagtgtaaagcctggtttttttgtttgcaagcagcagattacgcgcagaaaaaaggagaaggtcctggtgcctgacggtgagagcgacgacttggcggccactccagcgcaacccgaagaattacaggtacacaccgtcgtgccggaaaattcttcatgcacccgttattcacttaccaaatatcggatgaaccaagccgcggaggcatcaggtttcaagcttcttctatcagcattgtgcactacttcactgccttgtgcagtttgttagctgtggccccgcgctggc

SEQ ID NO: 3043 - DNA, 411 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttg

SEQ ID NO: 3044 - DNA, 445 bp, Artificial; identical to SEQ ID NO: 2217
  TaSBEIIa-B allele with mutations introduced by TALEN pair TaSBEIIa_T03

SEQ ID NO: 3045 - DNA, 430 bp, Artificial; identical to SEQ ID NO: 2455
  TaSBEIIa-B allele with mutations introduced by TALEN pair TaSBEIIa_T03

SEQ ID NO: 3046 - DNA, 512 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcaggtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaatcttcatggcaccccgttattcacttaccaaaatatcggatgaaccaagccgcggaggcatcaggtttcaagcttcttctatcagcattgtgcactacttcactgcccttgtgcagtttgttagctgtggccccgcgctggctcttgggccactg

SEQ ID NO: 3047 - DNA, 453 bp, Artificial; identical to SEQ ID NO: 2283
  TaSBEIIa-B allele with mutations introduced by TALEN pair TaSBEIIa_T03

SEQ ID NO: 3048 - DNA, 515 bp, Artificial; identical to SEQ ID NO: 2379
  TaSBEIIa-B allele with mutations introduced by TALEN pair TaSBEIIa_T03

SEQ ID NO: 3049 - DNA, 451 bp, Artificial; identical to SEQ ID NO: 2247
  TaSBEIIa-B allele with mutations introduced by TALEN pair TaSBEIIa_T03

SEQ ID NO: 3050 - DNA, 445 bp, Artificial; identical to SEQ ID NO: 2217
  TaSBEIIa-B allele with mutations introduced by TALEN pair TaSBEIIa_T03

SEQ ID NO: 3051 - DNA, 452 bp, Artificial; identical to SEQ ID NO: 2202
  TaSBEIIa-B allele with mutations introduced by TALEN pair TaSBEIIa_T03

SEQ ID NO: 3052 - DNA, 484 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagacagtaagagaattatgcagtgctgccataaccatgaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 3053 - DNA, 451 bp, Artificial; identical to SEQ ID NO: 2247
  TaSBEIIa-B allele with mutations introduced by TALEN pair TaSBEIIa_T03

SEQ ID NO: 3054 - DNA, 430 bp, Artificial; identical to SEQ ID NO: 2455
  TaSBEIIa-B allele with mutations introduced by TALEN pair TaSBEIIa_T03

SEQ ID NO: 3055 - DNA, 451 bp, Artificial; identical to SEQ ID NO: 2247
  TaSBEIIa-B allele with mutations introduced by TALEN pair TaSBEIIa_T03

SEQ ID NO: 3056 - DNA, 429 bp, Artificial; identical to SEQ ID NO: 2912
  TaSBEIIa-B allele with mutations introduced by TALEN pair TaSBEIIa_T03

SEQ ID NO: 3057 - DNA, 452 bp, Artificial; identical to SEQ ID NO: 2202
  TaSBEIIa-B allele with mutations introduced by TALEN pair TaSBEIIa_T03

SEQ ID NO: 3058 - DNA, 440 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctgg

SEQ ID NO: 3059 - DNA, 452 bp, Artificial; identical to SEQ ID NO: 2202
  TaSBEIIa-B allele with mutations introduced by TALEN pair TaSBEIIa_T03

SEQ ID NO: 3060 - DNA, 431 bp, Artificial; identical to SEQ ID NO: 2857
  TaSBEIIa-B allele with mutations introduced by TALEN pair TaSBEIIa_T03

SEQ ID NO: 3061 - DNA, 451 bp, Artificial; identical to SEQ ID NO: 2247
  TaSBEIIa-B allele with mutations introduced by TALEN pair TaSBEIIa_T03

SEQ ID NO: 3062 - DNA, 693 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaatttccacacaacatacgagccggaagcataaagtgtaaagcctggtttttttgtttgcaagcagcagattacgcgcagaaaaaaggagaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgt

SEQ ID NO: 3063 - DNA, 429 bp, Artificial; identical to SEQ ID NO: 2912
  TaSBEIIa-B allele with mutations introduced by TALEN pair TaSBEIIa_T03

SEQ ID NO: 3064 - DNA, 452 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcacccgttattcacttacccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 3065 - DNA, 493 bp, Artificial; identical to SEQ ID NO: 2310
  TaSBEIIa-B allele with mutations introduced by TALEN pair TaSBEIIa_T03

SEQ ID NO: 3066 - DNA, 453 bp, Artificial; identical to SEQ ID NO: 2283
  TaSBEIIa-B allele with mutations introduced by TALEN pair TaSBEIIa_T03

SEQ ID NO: 3067 - DNA, 444 bp, Artificial; identical to SEQ ID NO: 2303
  TaSBEIIa-B allele with mutations introduced by TALEN pair TaSBEIIa_T03

SEQ ID NO: 3068 - DNA, 504 bp, Artificial; identical to SEQ ID NO: 2405
  TaSBEIIa-B allele with mutations introduced by TALEN pair TaSBEIIa_T03

SEQ ID NO: 3069 - DNA, 452 bp, Artificial; identical to SEQ ID NO: 2202
  TaSBEIIa-B allele with mutations introduced by TALEN pair TaSBEIIa_T03

SEQ ID NO: 3070 - DNA, 447 bp, Artificial; identical to SEQ ID NO: 2856
  TaSBEIIa-B allele with mutations introduced by TALEN pair TaSBEIIa_T03

SEQ ID NO: 3071 - DNA, 451 bp, Artificial; identical to SEQ ID NO: 2247
  TaSBEIIa-B allele with mutations introduced by TALEN pair TaSBEIIa_T03

SEQ ID NO: 3072 - DNA, 493 bp, Artificial; identical to SEQ ID NO: 2310
  TaSBEIIa-B allele with mutations introduced by TALEN pair TaSBEIIa_T03

SEQ ID NO: 3073 - DNA, 444 bp, Artificial; identical to SEQ ID NO: 2303
  TaSBEIIa-B allele with mutations introduced by TALEN pair TaSBEIIa_T03

SEQ ID NO: 3074 - DNA, 448 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagtgctgcgctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 3075 - DNA, 711 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggttttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaaatatcggatgaaccaagccgcggaggcatcaggtttcaagcttcttctatcagcattgtgcactacttcactgccttgtgcagtttgttagctgtggccccgcgctggctc

SEQ ID NO: 3076 - DNA, 608 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcggggcgaaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagttgttagctgtggcccgcgctggctcttgggccactg

SEQ ID NO: 3077 - DNA, 505 bp, Artificial; identical to SEQ ID NO: 2365
  TaSBEIIa-B allele with mutations introduced by TALEN pair TaSBEIIa_T03

SEQ ID NO: 3078 - DNA, 493 bp, Artificial; identical to SEQ ID NO: 2310
  TaSBEIIa-B allele with mutations introduced by TALEN pair TaSBEIIa_T03

SEQ ID NO: 3079 - DNA, 515 bp, Artificial; identical to SEQ ID NO: 2379
  TaSBEIIa-B allele with mutations introduced by TALEN pair TaSBEIIa_T03

SEQ ID NO: 3080 - DNA, 452 bp, Artificial; identical to SEQ ID NO: 2202
  TaSBEIIa-B allele with mutations introduced by TALEN pair TaSBEIIa_T03

SEQ ID NO: 3081 - DNA, 505 bp, Artificial; identical to SEQ ID NO: 2365
  TaSBEIIa-B allele with mutations introduced by TALEN pair TaSBEIIa_T03

SEQ ID NO: 3082 - DNA, 515 bp, Artificial; identical to SEQ ID NO: 2379
  TaSBEIIa-B allele with mutations introduced by TALEN pair TaSBEIIa_T03

SEQ ID NO: 3083 - DNA, 721 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacgcagcagcagaacgaggaagattcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 3084 - DNA, 724 bp, Artificial
  TaSBEIIa-B allele with mutations introduced by TALEN pair TaSBEIIa_T03
gagatagctggattaggcgatcgcctcaggccctggtgttaccacggctttgatcatctcctcctttccattgctgatattttcttcactctttctttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 3085 - DNA, 424 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtgg

SEQ ID NO: 3086 - DNA, 452 bp, Artificial; identical to SEQ ID NO: 2202
  TaSBEIIa-B allele with mutations introduced by TALEN pair TaSBEIIa_T03

SEQ ID NO: 3087 - DNA, 675 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttctttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaaatatcggatgaaccaagccgcggaggcatcaggtttcaagcttcttctatcagcatgtgcactacttcactgccttg

SEQ ID NO: 3088 - DNA, 424 bp, Artificial
  TaSBEIIa-B allele with mutations introduced by TALEN pair TaSBEIIa_T03
  misc_feature (315): n is a or c or t or g
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttnttcacttaccaaatatcggatgaaccaagccgcggaggcatcaggtttcaagcttcttctatcagcattgtgcactacttcactgccttgtgcagtttgttagctgtgg

SEQ ID NO: 3089 - DNA, 451 bp, Artificial; identical to SEQ ID NO: 2247
  TaSBEIIa-B allele with mutations introduced by TALEN pair TaSBEIIa_T03

SEQ ID NO: 3090 - DNA, 507 bp, Artificial; identical to SEQ ID NO: 2777
  TaSBEIIa-B allele with mutations introduced by TALEN pair TaSBEIIa_T03

SEQ ID NO: 3091 - DNA, 510 bp, Artificial; identical to SEQ ID NO: 2277
  TaSBEIIa-B allele with mutations introduced by TALEN pair TaSBEIIa_T03

SEQ ID NO: 3092 - DNA, 439 bp, Artificial; identical to SEQ ID NO: 2508
  TaSBEIIa-B allele with mutations introduced by TALEN pair TaSBEIIa_T03

SEQ ID NO: 3093 - DNA, 430 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccctgacggtgagagcgacgacttggcggccactccagcgcaacccgaagaattacaggtacacaccgtcgtgccggaaaatcttcatgcacccgttattcacttaccaatatcggatgaaccaagccgcggaggcatcaggtttcaagcttcttctatcagcattgtgcactacttcactgccttgtgcagtttgttagctgtggccccgcgctggctc

SEQ ID NO: 3094 - DNA, 445 bp, Artificial; identical to SEQ ID NO: 2217
  TaSBEIIa-B allele with mutations introduced by TALEN pair TaSBEIIa_T03

SEQ ID NO: 3095 - DNA, 453 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatccggatgaaccaagccgcggaggcatcaggtttcaagcttcttctatcagcattgtgcactacttcactgccttgtgcagtttgttagctgtggccccgcgctggctcttgggcca

SEQ ID NO: 3096 - DNA, 451 bp, Artificial; identical to SEQ ID NO: 2247
  TaSBEIIa-B allele with mutations introduced by TALEN pair TaSBEIIa_T03

SEQ ID NO: 3097 - DNA, 709 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaggagaaggtcctggtgcctgacggtgagagcgacgacttggcggccactccagcgcaacccgaagaattacaggtacacaccgtcgtgccggaaaattcttcatgcacccgttattcacttaccaaatatcggatgaaccaagccgcggaggcatcaggtttcaagcttcttctatcagcattgtgcactacttcactgccttgtgcagtttgttagctgtggccccgcgctggctc

SEQ ID NO: 3098 - DNA, 451 bp, Artificial; identical to SEQ ID NO: 2247
  TaSBEIIa-B allele with mutations introduced by TALEN pair TaSBEIIa_T03

SEQ ID NO: 3099 - DNA, 600 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcggggcgaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 3100 - DNA, 453 bp, Artificial; identical to SEQ ID NO: 2283
  TaSBEIIa-B allele with mutations introduced by TALEN pair TaSBEIIa_T03

SEQ ID NO: 3101 - DNA, 453 bp, Artificial; identical to SEQ ID NO: 2283
  TaSBEIIa-B allele with mutations introduced by TALEN pair TaSBEIIa_T03

SEQ ID NO: 3102 - DNA, 462 bp, Artificial; identical to SEQ ID NO: 2620
  TaSBEIIa-B allele with mutations introduced by TALEN pair TaSBEIIa_T03

SEQ ID NO: 3103 - DNA, 494 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccagacagtaagagaattatgcagtgctgccataaccatgaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 3104 - DNA, 431 bp, Artificial; identical to SEQ ID NO: 2209
  TaSBEIIa-B allele with mutations introduced by TALEN pair TaSBEIIa_T03

SEQ ID NO: 3105 - DNA, 452 bp, Artificial; identical to SEQ ID NO: 2202
  TaSBEIIa-B allele with mutations introduced by TALEN pair TaSBEIIa_T03

SEQ ID NO: 3106 - DNA, 548 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaagttctgctatgtggcgcggtattatcccgtatcattggaaaacgttcttcggggcgaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcaccccgttattcacttaccaaatatcggatgaaccaagccgcggaggcatcaggtttcaagcttcttctatcagcattgtgc

SEQ ID NO: 3107 - DNA, 452 bp, Artificial; identical to SEQ ID NO: 2202
  TaSBEIIa-B allele with mutations introduced by TALEN pair TaSBEIIa_T03

SEQ ID NO: 3108 - DNA, 510 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaaatcttcatgcaccccgttattcacttaccaaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 3109 - DNA, 717 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttctttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggttttttgtttgcaagcagcagattacgcgcagaaaaaatggagaaggtcctggtgcctgacggtgagagcgacgacttggcgggccactccagcgcaacccgaagaattacaggtacacaccgtcgtgccggaaaatcttcatgcacccgttattcacttaccaaatatcggatgaaccaagccgcggaggcatcaggtttcaagcttcttcatcagcatgtgcactacttcaactgccttgtgcagtttgttagctgtggcccgcgctggctcttgggccactg

SEQ ID NO: 3110 - DNA, 609 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcggggcgaaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagttgttagctgtggcccgcgctggctcttgggccactg

SEQ ID NO: 3111 - DNA, 430 bp, Artificial; identical to SEQ ID NO: 2455
  TaSBEIIa-B allele with mutations introduced by TALEN pair TaSBEIIa_T03

SEQ ID NO: 3112 - DNA, 430 bp, Artificial; identical to SEQ ID NO: 2455
  TaSBEIIa-B allele with mutations introduced by TALEN pair TaSBEIIa_T03

SEQ ID NO: 3113 - DNA, 460 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagacagtaagagaattatgcagtgctgccataaccatgaaggtcctggtgcctgacggtgagagcgacgacttggcggccactccagcgcaacccgaagaattacaggctacacaccgtcgtgccggaaatcttacatgcacccgttattcacttaccaaattatcggatgaaccaagccgcggaggcatcaggtttcaagcttcttctatcagcattgtgcactacttcactgccttgtgcagtttg

SEQ ID NO: 3114 - DNA, 710 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttctttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaaatatcggatgaaccaagccgcggaggcatcaggtttcaagcttcttctatcagcattgtgcactacttcaactgccttgtgcagtttgttagctgtggccccgcgctggctc

SEQ ID NO: 3115 - DNA, 435 bp, Artificial; identical to SEQ ID NO: 2252
  TaSBEIIa-B allele with mutations introduced by TALEN pair TaSBEIIa_T03

SEQ ID NO: 3116 - DNA, 438 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagctcttctatcagcattgtgcactacttcactgccttgtgcagtttgttagctgtggccccgcgctggctctt

SEQ ID NO: 3117 - DNA, 452 bp, Artificial; identical to SEQ ID NO: 2202
  TaSBEIIa-B allele with mutations introduced by TALEN pair TaSBEIIa_T03

SEQ ID NO: 3118 - DNA, 446 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 3119 - DNA, 423 bp, Artificial; identical to SEQ ID NO: 2733
  TaSBEIIa-B allele with mutations introduced by TALEN pair TaSBEIIa_T03

SEQ ID NO: 3120 - DNA, 493 bp, Artificial; identical to SEQ ID NO: 2310
  TaSBEIIa-B allele with mutations introduced by TALEN pair TaSBEIIa_T03

SEQ ID NO: 3121 - DNA, 423 bp, Artificial; identical to SEQ ID NO: 2733
  TaSBEIIa-B allele with mutations introduced by TALEN pair TaSBEIIa_T03

SEQ ID NO: 3122 - DNA, 510 bp, Artificial; identical to SEQ ID NO: 2277
  TaSBEIIa-B allele with mutations introduced by TALEN pair TaSBEIIa_T03

SEQ ID NO: 3123 - DNA, 452 bp, Artificial; identical to SEQ ID NO: 2202
  TaSBEIIa-B allele with mutations introduced by TALEN pair TaSBEIIa_T03

SEQ ID NO: 3124 - DNA, 494 bp, Artificial; identical to SEQ ID NO: 3036
  TaSBEIIa-B allele with mutations introduced by TALEN pair TaSBEIIa_T03

SEQ ID NO: 3125 - DNA, 439 bp, Artificial; identical to SEQ ID NO: 2508
  TaSBEIIa-B allele with mutations introduced by TALEN pair TaSBEIIa_T03

SEQ ID NO: 3126 - DNA, 458 bp, Artificial
  TaSBEIIa-B allele with mutations introduced by TALEN pair TaSBEIIa_T03
  misc_feature (399): n is a or c or t or g
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgttgccggaaaatcttcatgcacccgttattcacttaccaaatatcggatgaaccaagccgcggtaggcatcagggtttcaagcttctttcgtatcaggcatttgngcactacttcactgcttgtgcagtttgttagctgtggccccgcgctggctcttgggcca

SEQ ID NO: 3127 - DNA, 709 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagttttgttagctgtggccccgcgctggctc

SEQ ID NO: 3128 - DNA, 452 bp, Artificial; identical to SEQ ID NO: 2202
  TaSBEIIa-B allele with mutations introduced by TALEN pair TaSBEIIa_T03

SEQ ID NO: 3129 - DNA, 494 bp, Artificial; identical to SEQ ID NO: 3036
  TaSBEIIa-B allele with mutations introduced by TALEN pair TaSBEIIa_T03

SEQ ID NO: 3130 - DNA, 422 bp, Artificial; identical to SEQ ID NO: 2727
  TaSBEIIa-B allele with mutations introduced by TALEN pair TaSBEIIa_T03

SEQ ID NO: 3131 - DNA, 452 bp, Artificial; identical to SEQ ID NO: 2202
  TaSBEIIa-B allele with mutations introduced by TALEN pair TaSBEIIa_T03

SEQ ID NO: 3132 - DNA, 452 bp, Artificial; identical to SEQ ID NO: 2202
  TaSBEIIa-B allele with mutations introduced by TALEN pair TaSBEIIa_T03

SEQ ID NO: 3133 - DNA, 452 bp, Artificial; identical to SEQ ID NO: 2202
  TaSBEIIa-B allele with mutations introduced by TALEN pair TaSBEIIa_T03

SEQ ID NO: 3134 - DNA, 452 bp, Artificial; identical to SEQ ID NO: 2202
  TaSBEIIa-B allele with mutations introduced by TALEN pair TaSBEIIa_T03

SEQ ID NO: 3135 - DNA, 485 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaatcttacatgcacccgttattcacttaccaaatcaatcggatgaaccaagccgcggaggcatcaggtttcaagcttcttctatcagcattgtgcactacttcactgccttgtgcagtttgttagctgtgg

SEQ ID NO: 3136 - DNA, 693 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaaatatcggatgaaccaagccgcggaggcatcaggtttcaagcttcttctatcagcatgtgcactacttcactgccttgtgcagtttgttagctgt

SEQ ID NO: 3137 - DNA, 439 bp, Artificial; identical to SEQ ID NO: 2508
  TaSBEIIa-B allele with mutations introduced by TALEN pair TaSBEIIa_T03

SEQ ID NO: 3138 - DNA, 600 bp, Artificial; identical to SEQ ID NO: 3099
  TaSBEIIa-B allele with mutations introduced by TALEN pair TaSBEIIa_T03

SEQ ID NO: 3139 - DNA, 494 bp, Artificial; identical to SEQ ID NO: 3036
  TaSBEIIa-B allele with mutations introduced by TALEN pair TaSBEIIa_T03

SEQ ID NO: 3140 - DNA, 452 bp, Artificial; identical to SEQ ID NO: 2202
  TaSBEIIa-B allele with mutations introduced by TALEN pair TaSBEIIa_T03

SEQ ID NO: 3141 - DNA, 452 bp, Artificial; identical to SEQ ID NO: 2202
  TaSBEIIa-B allele with mutations introduced by TALEN pair TaSBEIIa_T03

SEQ ID NO: 3142 - DNA, 452 bp, Artificial; identical to SEQ ID NO: 2202
  TaSBEIIa-B allele with mutations introduced by TALEN pair TaSBEIIa_T03

SEQ ID NO: 3143 - DNA, 453 bp, Artificial; identical to SEQ ID NO: 2283
  TaSBEIIa-B allele with mutations introduced by TALEN pair TaSBEIIa_T03

SEQ ID NO: 3144 - DNA, 712 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaaatatcggatgaaccaaagccgcggaggcatcaggtttcaagcttcttctatcagcattgtgcactacttcactgccttgtgcagtttgttagctgtggccccgcgctggctc

SEQ ID NO: 3145 - DNA, 516 bp, Artificial; identical to SEQ ID NO: 3040
  TaSBEIIa-B allele with mutations introduced by TALEN pair TaSBEIIa_T03

SEQ ID NO: 3146 - DNA, 430 bp, Artificial; identical to SEQ ID NO: 2455
  TaSBEIIa-B allele with mutations introduced by TALEN pair TaSBEIIa_T03

SEQ ID NO: 3147 - DNA, 452 bp, Artificial; identical to SEQ ID NO: 2202
  TaSBEIIa-B allele with mutations introduced by TALEN pair TaSBEIIa_T03

SEQ ID NO: 3148 - DNA, 678 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaatggagaaggtcctggtgcctgacggtgagagacgacgacttggcggccactccagcgcaacccgaagaattacaggtacacaccgtcgtgccggaaaatcttcatgcacccgttattcacttaccaaatatcggatgaaccaagccgcggaggcatcaggttcaagcttcttctatcagcattgtgcactacttcaactgccttg

SEQ ID NO: 3149 - DNA, 493 bp, Artificial; identical to SEQ ID NO: 2310
  TaSBEIIa-B allele with mutations introduced by TALEN pair TaSBEIIa_T03

SEQ ID NO: 3150 - DNA, 445 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggccttcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 3151 - DNA, 712 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaatggagaaggtcctggtgcctgacggtgagagcgacgacttggcggccactccagcgcaacccgaagaattacaggtacacaccgtcgtgccggaaaattcttcatgcacccgttattcacttaccaaatatcggatgaaccaagccgcggaggcatcaggtttcaagcttcttctatcagcatgtgcactacttcactgcctttgtgcagttttgttagctgtggccccgcgctggctc

SEQ ID NO: 3152 - DNA, 452 bp, Artificial; identical to SEQ ID NO: 2202
  TaSBEIIa-B allele with mutations introduced by TALEN pair TaSBEIIa_T03

SEQ ID NO: 3153 - DNA, 453 bp, Artificial; identical to SEQ ID NO: 2283
  TaSBEIIa-B allele with mutations introduced by TALEN pair TaSBEIIa_T03

SEQ ID NO: 3154 - DNA, 516 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccagggcgagcggtatcagctcactcaaaggcggtaatacggttatccacagaatcaggggaaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 3155 - DNA, 452 bp, Artificial; identical to SEQ ID NO: 2202
  TaSBEIIa-B allele with mutations introduced by TALEN pair TaSBEIIa_T03

SEQ ID NO: 3156 - DNA, 435 bp, Artificial; identical to SEQ ID NO: 2252
  TaSBEIIa-B allele with mutations introduced by TALEN pair TaSBEIIa_T03

SEQ ID NO: 3157 - DNA, 508 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagcgtttctgggtgagcaaaaacaggaaggcaaaatgccgcaaaaaagggaaggtcctggtgcctgacggtgagagcgacgacttggcggccactccagcgcaacccgaagaattacaggtacacaccgtcgtgccggaaaatcttcatgcacccgttattcacttacccaaattatcgggatgaaccaagccgcggaggcatcaggtttcaagcttcttctatcagcattgtgcactacttcactgccttgtgcagtttgttagctgtggccccgcgctggctcttgggccactg

SEQ ID NO: 3158 - DNA, 708 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcatgtgcactacttcactgccttgtgcagtttgttagctgtggccccgcgctggctc

SEQ ID NO: 3159 - DNA, 423 bp, Artificial; identical to SEQ ID NO: 2733
  TaSBEIIa-B allele with mutations introduced by TALEN pair TaSBEIIa_T03

SEQ ID NO: 3160 - DNA, 506 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccagcgtttctgggtgagcaaaaacaggaaggcaaaatgccgcaaaaaagggaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 3161 - DNA, 451 bp, Artificial; identical to SEQ ID NO: 2247
  TaSBEIIa-B allele with mutations introduced by TALEN pair TaSBEIIa_T03

SEQ ID NO: 3162 - DNA, 445 bp, Artificial; identical to SEQ ID NO: 2217
  TaSBEIIa-B allele with mutations introduced by TALEN pair TaSBEIIa_T03

SEQ ID NO: 3163 - DNA, 429 bp, Artificial; identical to SEQ ID NO: 2912
  TaSBEIIa-B allele with mutations introduced by TALEN pair TaSBEIIa_T03

SEQ ID NO: 3164 - DNA, 452 bp, Artificial; identical to SEQ ID NO: 2202
  TaSBEIIa-B allele with mutations introduced by TALEN pair TaSBEIIa_T03

SEQ ID NO: 3165 - DNA, 429 bp, Artificial; identical to SEQ ID NO: 2912
  TaSBEIIa-B allele with mutations introduced by TALEN pair TaSBEIIa_T03

SEQ ID NO: 3166 - DNA, 452 bp, Artificial; identical to SEQ ID NO: 2202
  TaSBEIIa-B allele with mutations introduced by TALEN pair TaSBEIIa_T03

SEQ ID NO: 3167 - DNA, 493 bp, Artificial; identical to SEQ ID NO: 2310
  TaSBEIIa-B allele with mutations introduced by TALEN pair TaSBEIIa_T03

SEQ ID NO: 3168 - DNA, 609 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcggggcgaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttggggccact

SEQ ID NO: 3169 - DNA, 451 bp, Artificial; identical to SEQ ID NO: 2247
  TaSBEIIa-B allele with mutations introduced by TALEN pair TaSBEIIa_T03

SEQ ID NO: 3170 - DNA, 424 bp, Artificial; identical to SEQ ID NO: 3085
  TaSBEIIa-B allele with mutations introduced by TALEN pair TaSBEIIa_T03

SEQ ID NO: 3171 - DNA, 436 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggc

SEQ ID NO: 3172 - DNA, 516 bp, Artificial; identical to SEQ ID NO: 2633
  TaSBEIIa-B allele with mutations introduced by TALEN pair TaSBEIIa_T03

SEQ ID NO: 3173 - DNA, 673 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttctttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaaggagaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagctcttctatcagcatgtgcactacttcactgccttg

SEQ ID NO: 3174 - DNA, 570 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcggggcgaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcag

SEQ ID NO: 3175 - DNA, 608 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcgggcgaaactctcaaggatcttaatcagtgaggcacctatctcagcgatctgtctattttgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactg

SEQ ID NO: 3176 - DNA, 438 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttccaagctcttctatcagcattgtgcactacttcactgccttgtgcagtttgttagctgtggccccgcgc

SEQ ID NO: 3177 - DNA, 508 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccattggatctagatgcattcgcgaggtaccgagctcgaattcactggccgtcgaaggtcctggtgcctgacggtgagagcgacgacttggcggccactccagcgcaacccgaagaattacaggtacacaccgtcgtgccggaaaaatcttcatgcaccccgttattcacttaccaaaatatcggatgaaccaagccgcggaggcatcaggtttcaagcttcttctatcagcattgtgcactacttcactgccttgtgcagtttgttagctgtggccccgcgctggctcttgggccac

SEQ ID NO: 3178 - DNA, 453 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 3179 - DNA, 451 bp, Artificial; identical to SEQ ID NO: 2247
  TaSBEIIa-B allele with mutations introduced by TALEN pair TaSBEIIa_T03

SEQ ID NO: 3180 - DNA, 439 bp, Artificial; identical to SEQ ID NO: 2266
  TaSBEIIa-B allele with mutations introduced by TALEN pair TaSBEIIa_T03

SEQ ID NO: 3181 - DNA, 679 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaggtaatctggaacatcgtatgggtaatcgatgaccttacgtttctttttaggatcgcccacgctcggctacagccagcagcaacaggagaagatcaaaccgaaggttcgctcgacagtggcgcagcaccacgaggtcatagctgtttcctgtgtgaaattgttatccgctcacaattccacacaacatacgagccggaagcataaagtgtaaagcctggttttttttgtttgcaagcagcagattacgcgcagaaaaaaaaggagaaggtcctggtgcctgacggtgagagcgacgaacttggcggccactccagcgcaacccgaagaattaacaggtacacaccgtcgtgccggaaaatcttcatgcacccgttattcacttaccaaaatatcggatgaaccaagccgcggaggcatcaggtttcaagcttcttctatcagcattgtgcactacttcaactgcc

SEQ ID NO: 3182 - DNA, 452 bp, Artificial; identical to SEQ ID NO: 2202
  TaSBEIIa-B allele with mutations introduced by TALEN pair TaSBEIIa_T03

SEQ ID NO: 3183 - DNA, 452 bp, Artificial; identical to SEQ ID NO: 2202
  TaSBEIIa-B allele with mutations introduced by TALEN pair TaSBEIIa_T03

SEQ ID NO: 3184 - DNA, 603 bp, Artificial
  TaSBEIIa-B allele with mutations introduced by TALEN pair TaSBEIIa_T03
gagatagctggattaggcgatcgcctcaggcccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcggggcgaaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctctt

SEQ ID NO: 3185 - DNA, 443 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccagggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggcccccgcgctggc

SEQ ID NO: 3186 - DNA, 526 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggcaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaaggagaaggtcctggtgcctgacggtgagagcgacgacttggcggccactccag

SEQ ID NO: 3187 - DNA, 424 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctcctggtgcctgacggtgagagcgacgacttggcggccactccagcgcaacccgaagaattacaggtacacaccgtcgtgccggaaaatcttcatgcaccccgttattcacttaccaaatatcggatgaaccaagccgcggaggcatcaggtttcaagcttcttctatcagcattgtgcactacttcactgccttgtgcagtttgttagctgtgg

SEQ ID NO: 3188 - DNA, 431 bp, Artificial
  TaSBEIIa-B allele with mutations introduced by TALEN pair TaSBEIIa_T03
  misc_feature (296): n is a or c or t or g
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaaggtcctggtgcctgacggtgagagcgacgacttggcggccactccagcgcaacccgaagaattacaggtacacaccgtcgngccggaaaatcttcatgcacccgttattcacttaccaaatatcggatgaaccaagccgcggaggcatcaaggttcaagcttcttctatcagcattgtgcactacttcactgccttgtgcagtttgttagctgtgg

SEQ ID NO: 3189 - DNA, 452 bp, Artificial; identical to SEQ ID NO: 2202
  TaSBEIIa-B allele with mutations introduced by TALEN pair TaSBEIIa_T03

SEQ ID NO: 3190 - DNA, 535 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaaatcgatgaccttacgtttctttttaggatcgcccacgctcggctacagccagcagcaacaggagaagatcaaaaccgaaggttcgttcgacagtggcgcagcaccacgaggtcatagctgtttcctgtgtgaaaattgttatccgctcacaattccacacaacatacgagccggaagcataaaagtgtaaaagcctggtttttttgtttgcaagcagcagattacgcgcagaaaaaaaaggagaaaggtcctggtgcctgacggtgagagcgacgacttggcggccactccagcgc

SEQ ID NO: 3191 - DNA, 452 bp, Artificial; identical to SEQ ID NO: 2202
  TaSBEIIa-B allele with mutations introduced by TALEN pair TaSBEIIa_T03

SEQ ID NO: 3192 - DNA, 445 bp, Artificial; identical to SEQ ID NO: 2217
  TaSBEIIa-B allele with mutations introduced by TALEN pair TaSBEIIa_T03

SEQ ID NO: 3193 - DNA, 445 bp, Artificial; identical to SEQ ID NO: 2217
  TaSBEIIa-B allele with mutations introduced by TALEN pair TaSBEIIa_T03

SEQ ID NO: 3194 - DNA, 452 bp, Artificial; identical to SEQ ID NO: 2202
  TaSBEIIa-B allele with mutations introduced by TALEN pair TaSBEIIa_T03

SEQ ID NO: 3195 - DNA, 453 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggcccccgcgctggctcttgggcca

SEQ ID NO: 3196 - DNA, 431 bp, Artificial; identical to SEQ ID NO: 2857
  TaSBEIIa-B allele with mutations introduced by TALEN pair TaSBEIIa_T03

SEQ ID NO: 3197 - DNA, 452 bp, Artificial; identical to SEQ ID NO: 2202
  TaSBEIIa-B allele with mutations introduced by TALEN pair TaSBEIIa_T03

SEQ ID NO: 3198 - DNA, 439 bp, Artificial
  TaSBEIIa-B allele with mutations introduced by TALEN pair TaSBEIIa_T03
gagatagctggattaggcgatcgcctcaggcccctggtgttaccacggctttgatcatctcctcctttcatgctgatattttctcactctttcttctgttcttgctgtaactgcaagttgtagcattttttttggcaaataagttgtagcattgtctcagtattgtactcatccttgcatttgcaggcgccgtcctgagccgcgcggcctctccaaggtcctggtgcctgacggtgagagcgacgacttggcggccactccagcgcaacccgaagaattacaggtacacaccgtccgatgccggaaaatcttccatgcaccccgttattcacttaccaaatatcggatgaaccaaggccgcggaggcattcaggtttcaagcttcttctatcagcattgtgcactacttcactgccttgttgcagtttgttagctgtgg

SEQ ID NO: 3199 - DNA, 416 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatatttttctcactctttcttctgttcttgctgtaactgcaagttgtagcattttttttggcaaataagttgtagcattgtctcagtattgtactcatccttgcatttgcaggcgccgtcctgagccgcgcggcctctccctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctg

SEQ ID NO: 3200 - DNA, 430 bp, Artificial; identical to SEQ ID NO: 2455
  TaSBEIIa-B allele with mutations introduced by TALEN pair TaSBEIIa_T03

SEQ ID NO: 3201 - DNA, 674 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaggtaatctggaacatcgtatgggtaatcgatgaccttacgtttcttttttaggatcgcccacgctcggctacagccagcagcaacaggagaagatcaaaccgaaggttcgttcgacagtggcgcagcaccacgaggtcatagctgtttcctgtgtgaaattgttatccgctcacaattccacacaacatacgagccggaagcataaagtgtaaagcctggtttttttgtttgcaagcagcagattacgcgcagaaaaaaggagaaggtcctggtgcctgacggtgagagcgacgacttggcggccactccagcgcaacccgaagaatttacaggtacacaccgtcgtgccggaaaattcttcatgcacccgttattcacttaccaaatatcggatgaccaagccgcggaggcatcaggtttcaagctcttctatcagcatgtgcactacttcactgccttg

SEQ ID NO: 3202 - DNA, 429 bp, Artificial; identical to SEQ ID NO: 2912
  TaSBEIIa-B allele with mutations introduced by TALEN pair TaSBEIIa_T03

SEQ ID NO: 3203 - DNA, 597 bp, Artificial
  TaSBEIIa-B allele with mutations introduced by TALEN pair TaSBEIIa_T03
gagatagctggattaggcgatcgcctcaggccctggtgttaccacggctttgatcatctcctcctttcatgctgatattttctcactctttcttctgttcttgctgtaactgcaagttgtagcatttttttggcaaataagttgtagcattgtctcagtattgtactcatccttgcatttgcaggcgccgtcctgagccgcgcggcctctccaacgttttccaatgatgagcacttttaaagttctgctatgtggcgcggtattatcccgtatcattggaaaacgttcttcggggcgaaaactctcaaggatcttaatcagtgaggcacctatctcagcgatctgtctatttcgttcatccatagttaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagttgttagctgtggccccgcgctggct

SEQ ID NO: 3204 - DNA, 452 bp, Artificial; identical to SEQ ID NO: 2202
  TaSBEIIa-B allele with mutations introduced by TALEN pair TaSBEIIa_T03

SEQ ID NO: 3205 - DNA, 428 bp, Artificial
  TaSBEIIa-B allele with mutations introduced by TALEN pair TaSBEIIa_T03
gagatagctggattaggcgatcgcctcaggccctggtgttaccacgggcttttgatcatctcctcctttcatgctgatatttttctcactctttcttctgttcttgctgtaactgcaagttgtagcatttttttggcaaataagttgtagcattgtctcagtattgtactcatccttgcatttgcaggcgccgtcctgagccgcgcggcctctccaggtcctggtgcctgacggtgagagcgacgacttggcggccactccagcgcaacccgaagaattacaggtacacaccgtcgtgccggaaaatcttcatgcaacccgttattcacttaccaaatatccggatgaaccaagccgcggaggcatcaggtttcaagcttcttctatcagcattgtgcactacttcactgccttgtgcagtttgttag

SEQ ID NO: 3206 - DNA, 493 bp, Artificial; identical to SEQ ID NO: 2310
  TaSBEIIa-B allele with mutations introduced by TALEN pair TaSBEIIa_T03

SEQ ID NO: 3207 - DNA, 439 bp, Artificial; identical to SEQ ID NO: 2508
  TaSBEIIa-B allele with mutations introduced by TALEN pair TaSBEIIa_T03

SEQ ID NO: 3208 - DNA, 457 bp, Artificial
  TaSBEIIa-D allele with mutations introduced by TALEN pair TaSBEIIa_T03
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcgggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactgccttgttcattttgttagccttggccccggctggtcttgggccac

SEQ ID NO: 3209 - DNA, 463 bp, Artificial
  TaSBEIIa-D allele with mutations introduced by TALEN pair TaSBEIIa_T03
gagatagctggattaggcgatcgcgcttcctgaacctgtatttttcccgcggagatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccgctgctggctcttgggccactgaa

SEQ ID NO: 3210 - DNA, 455 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3211 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3212 - DNA, 456 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3213 - DNA, 466 bp, Artificial
  TaSBEIIa-D allele with mutations introduced by TALEN pair TaSBEIIa_T03
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3214 - DNA, 466 bp, Artificial; identical to SEQ ID NO: 3213
  TaSBEIIa-D allele with mutations introduced by TALEN pair TaSBEIIa_T03

SEQ ID NO: 3215 - DNA, 459 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3216 - DNA, 446 bp, Artificial
  TaSBEIIa-D allele with mutations introduced by TALEN pair TaSBEIIa_T03
gagatagctggattaggcgatcgcgcttcctgaacctgtatttttccccgcgggaatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggccgtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3217 - DNA, 437 bp, Artificial
  TaSBEIIa-D allele with mutations introduced by TALEN pair TaSBEIIa_T03
gagatagctggattaggcgatcgcgcttcctgaacctgtatttttcccgcggacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 3218 - DNA, 450 bp, Artificial
  TaSBEIIa-D allele with mutations introduced by TALEN pair TaSBEIIa_T03
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3219 - DNA, 459 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgccggatgaaccaaccacggatgcgtcaggtttcgagcttcttctatcagcattgtgcagtactgcactgccttgttcattttgttagccttggccccgtcgtc

SEQ ID NO: 3220 - DNA, 422 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcgcgacgacttggcaagtccggcgcacctgaagaattacaggtacacacactcgtgccggtaaatcttctacaatcgttattcacttaccaaatgccggatgaaaccaaccacggatgcgtcaggtttcgagcttcttctatcagcattgtgcagtactgcactgccttgttcattttgttagccttgg

SEQ ID NO: 3221 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3222 - DNA, 484 bp, Artificial; identical to SEQ ID NO: 3211
  TaSBEIIa-D allele with mutations introduced by TALEN pair TaSBEIIa_T03

SEQ ID NO: 3223 - DNA, 483 bp, Artificial
  TaSBEIIa-D allele with mutations introduced by TALEN pair TaSBEIIa_T03
gagatagctggattaggcgatcgcgcttcctgaacctgtatttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtcgctggctcttgggccactgaa

SEQ ID NO: 3224 - DNA, 435 bp, Artificial
  TaSBEIIa-D allele with mutations introduced by TALEN pair TaSBEIIa_T03
gagatagctggattaggcgatcgcgcttcctgaacctgtatttttcccgcggagatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaaatcgttattcacttaccaaaatgccgggatgaaaccaaccacggattgccgtcaggttttcgagcttcttctacagcaattgtgcagtactgcactgccttgttcatttttgttag

SEQ ID NO: 3225 - DNA, 418 bp, Artificial
  TaSBEIIa-D allele with mutations introduced by TALEN pair TaSBEIIa_T03
gagatagctggattaggcgatcgcgcttcctgaacctgtatttttcccgcgggaagtgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctctccggcgagagcgacgacttggcaagtccggcgcaacctgaagaattacggtacacacactcgtgccggtaatcttcatacaatcgttattcacttaccaaaatgccggatgaaaccaaccacggatgcgtcaggtttcgagcttcttctacagcattgtgcagtactgcactgccttgttca

SEQ ID NO: 3226 - DNA, 466 bp, Artificial
  TaSBEIIa-D allele with mutations introduced by TALEN pair TaSBEIIa_T03
gagatagctggattaggcgatcgcgcttcctgaacctgtatttttcccgcgggaagatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3227 - DNA, 452 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagcattgtgcagtactgcactgccttgttcattttgttagccttggccccgtgctggc

SEQ ID NO: 3228 - DNA, 476 bp, Artificial
  TaSBEIIa-D allele with mutations introduced by TALEN pair TaSBEIIa_T03
gagatagctggattaggcgatcgcgcttcctgaacctgtattttttccccgcgggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgtctggctcttgggccactgaa

SEQ ID NO: 3229 - DNA, 478 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3230 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3231 - DNA, 475 bp, Artificial
  TaSBEIIa-D allele with mutations introduced by TALEN pair TaSBEIIa_T03
gagatagctggattaggcgatcgcgcttcctgaacctgtattttttccccgcgggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3232 - DNA, 474 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttctgctgtaactgcaagttgtggcgttttttcactattgtagtcatccttgcattttgcaggcgccgtcctgagccgcgcggcctctgtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgtctggctcttgggccactgaa

SEQ ID NO: 3233 - DNA, 465 bp, Artificial
  TaSBEIIa-D allele with mutations introduced by TALEN pair TaSBEIIa_T03
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgctgctggctcttgggccactg

SEQ ID NO: 3234 - DNA, 450 bp, Artificial
  TaSBEIIa-D allele with mutations introduced by TALEN pair TaSBEIIa_T03
gagatagctggattaggcgatcgcgcttcctgaacctgtattttttcccgcggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtttattttgttagccttgg

SEQ ID NO: 3235 - DNA, 482 bp, Artificial
  TaSBEIIa-D allele with mutations introduced by TALEN pair TaSBEIIa_T03
gagatagctggattaggcgatcgcgcttcctgaacctgtatttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3236 - DNA, 465 bp, Artificial
  TaSBEIIa-D allele with mutations introduced by TALEN pair TaSBEIIa_T03
gagatagctggattaggcgatcgcgcttcctgaacctgtatttttcccgcgggaagtgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3237 - DNA, 466 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3238 - DNA, 483 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3239 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3240 - DNA, 484 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3241 - DNA, 472 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcca

SEQ ID NO: 3242 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3243 - DNA, 440 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 3244 - DNA, 457 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3245 - DNA, 478 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgtctggctcttgggccactgaa

SEQ ID NO: 3246 - DNA, 484 bp, Artificial; identical to SEQ ID NO: 3211
  TaSBEIIa-D allele with mutations introduced by TALEN pair TaSBEIIa_T03

SEQ ID NO: 3247 - DNA, 483 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3248 - DNA, 447 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcacctgaagaattacaggtacacacactcgtgccggtaaatcttctacaatcgttattcacttaccaaatgccggatgaaccaaccacggatgcgtcaggtttcgagcttcttctatcagcattgtgcagtactgcactgccttgttcattttgttagccttggccccgtgctggctcttgggccactg

SEQ ID NO: 3249 - DNA, 448 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcgcgacgacttggcaagtccggcgcaacctgaagaattacaggtacacacactcgtgccggtaaatcttctacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 3250 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3251 - DNA, 438 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagcattgtgcagtactgcactgccttgttcattttgttagccttgg

SEQ ID NO: 3252 - DNA, 482 bp, Artificial
  TaSBEIIa-D allele with mutations introduced by TALEN pair TaSBEIIa_T03
gagatagctggattaggcgatcgcgcttcctgaacctgtattttttcccgcgggaacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtcgctggctcttgggccactgaa

SEQ ID NO: 3253 - DNA, 454 bp, Artificial
  TaSBEIIa-D allele with mutations introduced by TALEN pair TaSBEIIa_T03
gagatagctggattaggcgatcgcgcttcctgaacctgtatttttcccgcgggaatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3254 - DNA, 484 bp, Artificial
  TaSBEIIa-D allele with mutations introduced by TALEN pair TaSBEIIa_T03
gagatagctggattaggcgatcgcgcttcctgaacctgtattttttcccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3255 - DNA, 466 bp, Artificial
  TaSBEIIa-D allele with mutations introduced by TALEN pair TaSBEIIa_T03
gagatagctggattaggcgatcgcgcttcctgaacctgtatttttcccgcgggaagatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 3256 - DNA, 484 bp, Artificial; identical to SEQ ID NO: 3242
  TaSBEIIa-D allele with mutations introduced by TALEN pair TaSBEIIa_T03

SEQ ID NO: 3257 - DNA, 455 bp, Artificial
  TaSBEIIa-D allele with mutations introduced by TALEN pair TaSBEIIa_T03
gagatagctggattaggcgatcgcgcttcctgaacctgtattttttcccgcggacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccg

SEQ ID NO: 3258 - DNA, 405 bp, Artificial
  TaSBEIIa-D allele with mutations introduced by TALEN pair TaSBEIIa_T03
gagatagctggattaggcgatcgcgcttcctgaacctgtatttttcccgcgggaagtgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagcctgacggcgagagcgacgacttggcaagtccggcgcaacctgaagaattacaggtacacacactcgtgccggtaatcttcatacaatcgttattcacttaccaaatgccggatgaaaccaaccacggatgcgtcaggtttcgagcttcttctacagcattgtgcagtactgcactgccttg

SEQ ID NO: 3259 - DNA, 511 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcacgacggccagtgaattcgagctcggtacctcgcgaatgcatctagatccatgcttccggctcgtatgttgtgtggaggtcctggtgcctgacggcgagagcgacgacttggcaagtccggcgcaactgaagaattacaggtacacacactcgtgccggtaaatcttcatacaatcggttattcacttacccaaaatgcccgggtgaaaacaaccacggatgcgtcaggtttcgagcttcttctacagcattgtgcagtactgcactgcc

SEQ ID NO: 3260 - DNA, 452 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3261 - DNA, 424 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggattgccgtcaggttttcgagcttcttcttacagcattgtgcagtactgcactgccttg

SEQ ID NO: 3262 - DNA, 456 bp, Artificial
  TaSBEIIa-D allele with mutations introduced by TALEN pair TaSBEIIa_T03
gagatagctggattaggcgatcgcgcttcctgaacctgtatttttcccgcgggaagtgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggccaaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3263 - DNA, 481 bp, Artificial
  TaSBEIIa-D allele with mutations introduced by TALEN pair TaSBEIIa_T03
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3264 - DNA, 463 bp, Artificial
  TaSBEIIa-D allele with mutations introduced by TALEN pair TaSBEIIa_T03
gagatagctggattaggcgatcgcgcttcctgaacctgtatttttcccgcggagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccgctgctggctcttgggccactgaa

SEQ ID NO: 3265 - DNA, 465 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtcg

SEQ ID NO: 3266 - DNA, 453 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3267 - DNA, 466 bp, Artificial; identical to SEQ ID NO: 3237
  TaSBEIIa-D allele with mutations introduced by TALEN pair TaSBEIIa_T03

SEQ ID NO: 3268 - DNA, 481 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgactttgggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3269 - DNA, 482 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3270 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3271 - DNA, 502 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaggccagcaaaaggccaggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 3272 - DNA, 482 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttacattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3273 - DNA, 465 bp, Artificial
  TaSBEIIa-D allele with mutations introduced by TALEN pair TaSBEIIa_T03
  misc_feature (427): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcacnacttcactgccttgtgcagtttgttagctgtggccccg

SEQ ID NO: 3274 - DNA, 454 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3275 - DNA, 452 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccacctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcctt

SEQ ID NO: 3276 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3277 - DNA, 465 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcatggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcca

SEQ ID NO: 3278 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3279 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3280 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3281 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3282 - DNA, 402 bp, Artificial
  TaSBEIIa-D allele with mutations introduced by TALEN pair TaSBEIIa_T03
gagatagctggattaggcgatcgcgcttcctgaacctgtattttttccccgcgggaatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcgcgacgacttggcaagtccggcgcacctgaagaattacaggtacacacactcgtgccggtaaatcttctacaatcgttattcacttaccaaatgccggatgaaaccaaccacggatgcgtcaggtttcgagcttcttctatcagcattgtgcagtactgcactgccttg

SEQ ID NO: 3283 - DNA, 449 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3284 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3285 - DNA, 429 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttccgttcttgctgtaactgcaagttgtggcgttttttcacttattgtagtcatccttgcattttgcaggcgcctgtcctgagccgcgcggccttctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgcc

SEQ ID NO: 3286 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3287 - DNA, 468 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 3288 - DNA, 484 bp, Artificial; identical to SEQ ID NO: 3242
  TaSBEIIa-D allele with mutations introduced by TALEN pair TaSBEIIa_T03

SEQ ID NO: 3289 - DNA, 466 bp, Artificial
  TaSBEIIa-D allele with mutations introduced by TALEN pair TaSBEIIa_T03
gagatagctggattaggcgatcgcgcttcctgaacctgtattttttcccgcggaacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3290 - DNA, 485 bp, Artificial
  TaSBEIIa-D allele with mutations introduced by TALEN pair TaSBEIIa_T03
gagatagctggattaggcgatcgcgcttcctgaacctgtattttttccccgctgggaacgtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3291 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgatggctcttgggccactgaa

SEQ ID NO: 3292 - DNA, 483 bp, Artificial; identical to SEQ ID NO: 3279
  TaSBEIIa-D allele with mutations introduced by TALEN pair TaSBEIIa_T03

SEQ ID NO: 3293 - DNA, 480 bp, Artificial; identical to SEQ ID NO: 3284
  TaSBEIIa-D allele with mutations introduced by TALEN pair TaSBEIIa_T03

SEQ ID NO: 3294 - DNA, 483 bp, Artificial; identical to SEQ ID NO: 3279
  TaSBEIIa-D allele with mutations introduced by TALEN pair TaSBEIIa_T03

SEQ ID NO: 3295 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtactggtcgctgactggcgagagcgacgacttggtcaagtccggcgcacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3296 - DNA, 457 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3297 - DNA, 485 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggccgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3298 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3299 - DNA, 474 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgtcgctggctcttgggccactg

SEQ ID NO: 3300 - DNA, 460 bp, Artificial
  TaSBEIIa-D allele with mutations introduced by TALEN pair TaSBEIIa_T03
  misc_feature (444): n is a or c or t or g
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactgccttgttcattttgttagccttggccccgngctggtcttgggccac

SEQ ID NO: 3301 - DNA, 484 bp, Artificial; identical to SEQ ID NO: 3242
  TaSBEIIa-D allele with mutations introduced by TALEN pair TaSBEIIa_T03

SEQ ID NO: 3302 - DNA, 460 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccc

SEQ ID NO: 3303 - DNA, 473 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 3304 - DNA, 482 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3305 - DNA, 418 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctacagcattgtgcagtactgcactgccttg

SEQ ID NO: 3306 - DNA, 464 bp, Artificial
  TaSBEIIa-D allele with mutations introduced by TALEN pair TaSBEIIa_T03
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcatgttgcagtactgcactgccttgttcatttttgttagccttggccccgtgctggctcttgggccactg

SEQ ID NO: 3307 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3308 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3309 - DNA, 485 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3310 - DNA, 484 bp, Artificial; identical to SEQ ID NO: 3242
  TaSBEIIa-D allele with mutations introduced by TALEN pair TaSBEIIa_T03

SEQ ID NO: 3311 - DNA, 484 bp, Artificial; identical to SEQ ID NO: 3242
  TaSBEIIa-D allele with mutations introduced by TALEN pair TaSBEIIa_T03

SEQ ID NO: 3312 - DNA, 461 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctgggtgcctgacggcgagagcgacgactttgggcaagtccggcgcaacctgaagaattacaggtacacacactcgtgccggtaaatcttcatacaatcgttattcactttaccaaatgccggatgaaaccaaccacggatgcgtcaggtttcgagcttcttctatcagcattgtgcagtactgcactgccttgttcattttgttagccttggccccgtg

SEQ ID NO: 3313 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3314 - DNA, 466 bp, Artificial; identical to SEQ ID NO: 3237
  TaSBEIIa-D allele with mutations introduced by TALEN pair TaSBEIIa_T03

SEQ ID NO: 3315 - DNA, 465 bp, Artificial
  TaSBEIIa-D allele with mutations introduced by TALEN pair TaSBEIIa_T03
gagatagctggattaggcgatcgcgcttcctgaacctgtattttttccgcggaggatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgctgctggctcttgggccactgaa

SEQ ID NO: 3316 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3317 - DNA, 461 bp, Artificial
  TaSBEIIa-D allele with mutations introduced by TALEN pair TaSBEIIa_T03
  misc_feature (445): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgngctggtcttgggccac

SEQ ID NO: 3318 - DNA, 482 bp, Artificial; identical to SEQ ID NO: 3313
  TaSBEIIa-D allele with mutations introduced by TALEN pair TaSBEIIa_T03

SEQ ID NO: 3319 - DNA, 483 bp, Artificial; identical to SEQ ID NO: 3279
  TaSBEIIa-D allele with mutations introduced by TALEN pair TaSBEIIa_T03

SEQ ID NO: 3320 - DNA, 470 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3321 - DNA, 423 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctacagcattgtgcagtactgcactgccttgttcattttgttag

SEQ ID NO: 3322 - DNA, 505 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctctccgtccagcgcctgcttgccaccgccattgctggcgatggccaccacctgctgggaggtcctggtgcctgacggcgagagcgacgacttggcaagtccggcgcaacctgaagaattacaggtacacacactcgtgccggtaaatcttcatacaatcgttattcacttaccaaatgccggtgaaaccaaccacggatgcgtcaggtttcgagcttcttctatcagcattgtgcagtactgcactgccttgttcatttgttagccttgg

SEQ ID NO: 3323 - DNA, 483 bp, Artificial; identical to SEQ ID NO: 3280
  TaSBEIIa-D allele with mutations introduced by TALEN pair TaSBEIIa_T03

SEQ ID NO: 3324 - DNA, 451 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctctgtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgt

SEQ ID NO: 3325 - DNA, 483 bp, Artificial; identical to SEQ ID NO: 3279
  TaSBEIIa-D allele with mutations introduced by TALEN pair TaSBEIIa_T03

SEQ ID NO: 3326 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3327 - DNA, 455 bp, Artificial
  TaSBEIIa-D allele with mutations introduced by TALEN pair TaSBEIIa_T03
gagatagctggattaggcgatcgcgcttcctgaacctgtattttttcccgcggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3328 - DNA, 468 bp, Artificial
  TaSBEIIa-D allele with mutations introduced by TALEN pair TaSBEIIa_T03
gagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3329 - DNA, 503 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgtctggctcttgggccactgaacgagactgccaaggcacacagggga

SEQ ID NO: 3330 - DNA, 483 bp, Artificial; identical to SEQ ID NO: 3279
  TaSBEIIa-D allele with mutations introduced by TALEN pair TaSBEIIa_T03

SEQ ID NO: 3331 - DNA, 434 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 3332 - DNA, 482 bp, Artificial
  TaSBEIIa-D allele with mutations introduced by TALEN pair TaSBEIIa_T03
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3333 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3334 - DNA, 508 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctgggaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttgttagccttgg

SEQ ID NO: 3335 - DNA, 408 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggttttcgagcttcttctacagcattgtgcagtac

SEQ ID NO: 3336 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3337 - DNA, 518 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaggccagcaaaaggccaggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3338 - DNA, 483 bp, Artificial; identical to SEQ ID NO: 3279
  TaSBEIIa-D allele with mutations introduced by TALEN pair TaSBEIIa_T03

SEQ ID NO: 3339 - DNA, 484 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3340 - DNA, 470 bp, Artificial; identical to SEQ ID NO: 3320
  TaSBEIIa-D allele with mutations introduced by TALEN pair TaSBEIIa_T03

SEQ ID NO: 3341 - DNA, 483 bp, Artificial; identical to SEQ ID NO: 3279
  TaSBEIIa-D allele with mutations introduced by TALEN pair TaSBEIIa_T03

SEQ ID NO: 3342 - DNA, 454 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3343 - DNA, 466 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcccggagcaggtggtggccatcgccagccacgatggcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacgggatgcgtcaggttttcgagcttcttctatcagcattgtgcag

SEQ ID NO: 3344 - DNA, 467 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 3345 - DNA, 422 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactgccttgttca

SEQ ID NO: 3346 - DNA, 477 bp, Artificial
  TaSBEIIa-D allele with mutations introduced by TALEN pair TaSBEIIa_T03
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3347 - DNA, 484 bp, Artificial; identical to SEQ ID NO: 3240
  TaSBEIIa-D allele with mutations introduced by TALEN pair TaSBEIIa_T03

SEQ ID NO: 3348 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccacctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3349 - DNA, 463 bp, Artificial
  TaSBEIIa-D allele with mutations introduced by TALEN pair TaSBEIIa_T03
gagatagctggattaggcgatcgcgcttcctgaacctgtattttttcccgcgggaacgatgcgttagtgtcacccaggccctggtgttaccacggctttgatcattcctcgtttcattctgatatatattttctcactctttttcttccgttcttgctgtaactgcaagttgtggcgttttttcacttattgtagtcatccttgcattttgcaggcgccgtcctgagccgcgcggcctctccagggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccg

SEQ ID NO: 3350 - DNA, 456 bp, Artificial
  TaSBEIIa-D allele with mutations introduced by TALEN pair TaSBEIIa_T03
gagatagctggattaggcgatcgcgcttcctgaacctgtattttttccccgcggggaaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 3351 - DNA, 468 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3352 - DNA, 469 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctgggaggtcctggtgcctgacggcgagagcgacgacttggcaagtccggcgcaacctgaagaattacaggtacacacactcgtgccggtaaatcttctacaatcgttattcacttaccaatgccggatgaaaccaccacggatgcgtcaggtttcgagcttcttctatcagcattgtg

SEQ ID NO: 3353 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaaattgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3354 - DNA, 462 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgt

SEQ ID NO: 3355 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattataggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3356 - DNA, 480 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccact

SEQ ID NO: 3357 - DNA, 484 bp, Artificial; identical to SEQ ID NO: 3242
  TaSBEIIa-D allele with mutations introduced by TALEN pair TaSBEIIa_T03

SEQ ID NO: 3358 - DNA, 405 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcacctgaagaattacaggtacacacactcgtgccggtaaatcttctacaatcgttattcacttaccaaatgccggatgaaaccaaccacggatgcgtcaggtttcgagcttcttctatcagcattgtgcagtactgcactgccttg

SEQ ID NO: 3359 - DNA, 477 bp, Artificial
  TaSBEIIa-D allele with mutations introduced by TALEN pair TaSBEIIa_T03
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgtctggctcttgggccactgaa

SEQ ID NO: 3360 - DNA, 469 bp, Artificial
  TaSBEIIa-D allele with mutations introduced by TALEN pair TaSBEIIa_T03
  misc_feature (455): n is a or c or t or g
gagatagctggattaggcgatcgcgcttcctgaacctgtattttttccccgcgggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggcncttgggccactgaa

SEQ ID NO: 3361 - DNA, 468 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3362 - DNA, 484 bp, Artificial; identical to SEQ ID NO: 3211
  TaSBEIIa-D allele with mutations introduced by TALEN pair TaSBEIIa_T03

SEQ ID NO: 3363 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgtctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3364 - DNA, 455 bp, Artificial
  TaSBEIIa-D allele with mutations introduced by TALEN pair TaSBEIIa_T03
gagatagctggattaggcgatcgcgcttcctgaacctgtattttttcccgcggacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3365 - DNA, 468 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3366 - DNA, 483 bp, Artificial; identical to SEQ ID NO: 3279
  TaSBEIIa-D allele with mutations introduced by TALEN pair TaSBEIIa_T03

SEQ ID NO: 3367 - DNA, 482 bp, Artificial; identical to SEQ ID NO: 3313
  TaSBEIIa-D allele with mutations introduced by TALEN pair TaSBEIIa_T03

SEQ ID NO: 3368 - DNA, 456 bp, Artificial
  TaSBEIIa-D allele with mutations introduced by TALEN pair TaSBEIIa_T03
gagatagctggattaggcgatcgcgcttcctgaacctgttatttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccc

SEQ ID NO: 3369 - DNA, 481 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtattgcactgccttgttcattttgttagccttggccccgtgctggctcttgggccactg

SEQ ID NO: 3370 - DNA, 424 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggttttcgagcttcttctacagcattgtgcagtactgcactgccttgttca

SEQ ID NO: 3371 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3372 - DNA, 467 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3373 - DNA, 442 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcagtttcgagcttcttctatcagcattgtgcagtactgcactgccttgttcattttgttagccttgg

SEQ ID NO: 3374 - DNA, 483 bp, Artificial; identical to SEQ ID NO: 3279
  TaSBEIIa-D allele with mutations introduced by TALEN pair TaSBEIIa_T03

SEQ ID NO: 3375 - DNA, 483 bp, Artificial; identical to SEQ ID NO: 3280
  TaSBEIIa-D allele with mutations introduced by TALEN pair TaSBEIIa_T03

SEQ ID NO: 3376 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggttcgttttttcactattgtagtcatccttgcatttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3377 - DNA, 456 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3378 - DNA, 469 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3379 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3380 - DNA, 444 bp, Artificial
  TaSBEIIa-D allele with mutations introduced by TALEN pair TaSBEIIa_T03
gagatagctggattaggcgatcgcgcttcctgaacctgtattttttcccgcggacgatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagcattgtgcagtactgcactgccttgttcattttgttagccttggccccg

SEQ ID NO: 3381 - DNA, 483 bp, Artificial; identical to SEQ ID NO: 3279
  TaSBEIIa-D allele with mutations introduced by TALEN pair TaSBEIIa_T03

SEQ ID NO: 3382 - DNA, 470 bp, Artificial; identical to SEQ ID NO: 3320
  TaSBEIIa-D allele with mutations introduced by TALEN pair TaSBEIIa_T03

SEQ ID NO: 3383 - DNA, 466 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3384 - DNA, 479 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccacctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3385 - DNA, 479 bp, Artificial; identical to SEQ ID NO: 3326
  TaSBEIIa-D allele with mutations introduced by TALEN pair TaSBEIIa_T03

SEQ ID NO: 3386 - DNA, 483 bp, Artificial; identical to SEQ ID NO: 3279
  TaSBEIIa-D allele with mutations introduced by TALEN pair TaSBEIIa_T03

SEQ ID NO: 3387 - DNA, 481 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3388 - DNA, 484 bp, Artificial; identical to SEQ ID NO: 3242
  TaSBEIIa-D allele with mutations introduced by TALEN pair TaSBEIIa_T03

SEQ ID NO: 3389 - DNA, 469 bp, Artificial; identical to SEQ ID NO: 3378
  TaSBEIIa-D allele with mutations introduced by TALEN pair TaSBEIIa_T03

SEQ ID NO: 3390 - DNA, 458 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3391 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3392 - DNA, 483 bp, Artificial; identical to SEQ ID NO: 3279
  TaSBEIIa-D allele with mutations introduced by TALEN pair TaSBEIIa_T03

SEQ ID NO: 3393 - DNA, 482 bp, Artificial
  TaSBEIIa-D allele with mutations introduced by TALEN pair TaSBEIIa_T03
gagatagctggattaggcgatcgcgcttcctgaacctgtattttttcccgcgggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactggaa

SEQ ID NO: 3394 - DNA, 492 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttg

SEQ ID NO: 3395 - DNA, 478 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3396 - DNA, 480 bp, Artificial; identical to SEQ ID NO: 3333
  TaSBEIIa-D allele with mutations introduced by TALEN pair TaSBEIIa_T03

SEQ ID NO: 3397 - DNA, 483 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3398 - DNA, 423 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactgccttgttca

SEQ ID NO: 3399 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3400 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3401 - DNA, 482 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgtctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3402 - DNA, 483 bp, Artificial; identical to SEQ ID NO: 3279
  TaSBEIIa-D allele with mutations introduced by TALEN pair TaSBEIIa_T03

SEQ ID NO: 3403 - DNA, 453 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcc

SEQ ID NO: 3404 - DNA, 479 bp, Artificial; identical to SEQ ID NO: 3326
  TaSBEIIa-D allele with mutations introduced by TALEN pair TaSBEIIa_T03

SEQ ID NO: 3405 - DNA, 474 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggcca

SEQ ID NO: 3406 - DNA, 459 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3407 - DNA, 532 bp, Artificial
  TaSBEIIa-D allele with mutations introduced by TALEN pair TaSBEIIa_T03
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgactggtgagtactcaaccaagtcattctgagaatagtcagcatgttcactacggaacaagtcggaataaagctaagaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctacagcattgtgcaagtactgcactgccttgttcatttttgttag

SEQ ID NO: 3408 - DNA, 469 bp, Artificial; identical to SEQ ID NO: 3378
  TaSBEIIa-D allele with mutations introduced by TALEN pair TaSBEIIa_T03

SEQ ID NO: 3409 - DNA, 466 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3410 - DNA, 452 bp, Artificial
  TaSBEIIa-D allele with mutations introduced by TALEN pair TaSBEIIa_T03
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagcattgtgcagtactgcactgccttgttcattttgttagccttggccccgtgctggc

SEQ ID NO: 3411 - DNA, 457 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcttggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3412 - DNA, 484 bp, Artificial; identical to SEQ ID NO: 3239
  TaSBEIIa-D allele with mutations introduced by TALEN pair TaSBEIIa_T03

SEQ ID NO: 3413 - DNA, 480 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3414 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3415 - DNA, 440 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcacctgaagaattacaggtacacacactcgtgccggtaaatcttctacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 3416 - DNA, 483 bp, Artificial; identical to SEQ ID NO: 3279
  TaSBEIIa-D allele with mutations introduced by TALEN pair TaSBEIIa_T03

SEQ ID NO: 3417 - DNA, 454 bp, Artificial
  TaSBEIIa-D allele with mutations introduced by TALEN pair TaSBEIIa_T03
gagatagctggattaggcgatcgcgcttcctgaacctgtattttttcccgcggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3418 - DNA, 484 bp, Artificial; identical to SEQ ID NO: 3242
  TaSBEIIa-D allele with mutations introduced by TALEN pair TaSBEIIa_T03

SEQ ID NO: 3419 - DNA, 483 bp, Artificial; identical to SEQ ID NO: 3221
  TaSBEIIa-D allele with mutations introduced by TALEN pair TaSBEIIa_T03

SEQ ID NO: 3420 - DNA, 481 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3421 - DNA, 484 bp, Artificial; identical to SEQ ID NO: 3242
  TaSBEIIa-D allele with mutations introduced by TALEN pair TaSBEIIa_T03

SEQ ID NO: 3422 - DNA, 478 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3423 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3424 - DNA, 484 bp, Artificial; identical to SEQ ID NO: 3242
  TaSBEIIa-D allele with mutations introduced by TALEN pair TaSBEIIa_T03

SEQ ID NO: 3425 - DNA, 484 bp, Artificial; identical to SEQ ID NO: 3242
  TaSBEIIa-D allele with mutations introduced by TALEN pair TaSBEIIa_T03

SEQ ID NO: 3426 - DNA, 484 bp, Artificial; identical to SEQ ID NO: 3242
  TaSBEIIa-D allele with mutations introduced by TALEN pair TaSBEIIa_T03

SEQ ID NO: 3427 - DNA, 484 bp, Artificial; identical to SEQ ID NO: 3211
  TaSBEIIa-D allele with mutations introduced by TALEN pair TaSBEIIa_T03

SEQ ID NO: 3428 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3429 - DNA, 502 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttg

SEQ ID NO: 3430 - DNA, 482 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3431 - DNA, 479 bp, Artificial; identical to SEQ ID NO: 3308
  TaSBEIIa-D allele with mutations introduced by TALEN pair TaSBEIIa_T03

SEQ ID NO: 3432 - DNA, 423 bp, Artificial
  TaSBEIIa-D allele with mutations introduced by TALEN pair TaSBEIIa_T03
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgactggtgagtactcaaccaagtcattctgagaatagtcagcatgttcactacggaacaagtcggaataaagctagaaaggtcctggtgcctgacggcgagagcgacgacttggcaagtccggcgcaacctgaagaattacaggtacacacactcgtgccggtaaatcttcatacaatcg

SEQ ID NO: 3433 - DNA, 480 bp, Artificial; identical to SEQ ID NO: 3284
  TaSBEIIa-D allele with mutations introduced by TALEN pair TaSBEIIa_T03

SEQ ID NO: 3434 - DNA, 420 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactgccttg

SEQ ID NO: 3435 - DNA, 477 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3436 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3437 - DNA, 479 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3438 - DNA, 484 bp, Artificial
  TaSBEIIa-D allele with mutations introduced by TALEN pair TaSBEIIa_T03
gagatagctggattaggcgatcgcgcttcctgaacctgtattttttccccgcgggaacgtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3439 - DNA, 482 bp, Artificial; identical to SEQ ID NO: 3313
  TaSBEIIa-D allele with mutations introduced by TALEN pair TaSBEIIa_T03

SEQ ID NO: 3440 - DNA, 469 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3441 - DNA, 466 bp, Artificial
  TaSBEIIa-D allele with mutations introduced by TALEN pair TaSBEIIa_T03
gagatagctggattaggcgatcgcgcttcctgaacctgtatttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3442 - DNA, 452 bp, Artificial
  TaSBEIIa-D allele with mutations introduced by TALEN pair TaSBEIIa_T03
  misc_feature (436): n is a or c or t or g
gagatagctggattaggcgatcgcgcttcctgaacctgtattttttcccgctgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaatcttcatacaatcgttattcacttaccaaaatgccggatgaaaccaaccacggattgcgtcaggtttcgagcttcttctacagcattgtgcagtactgcactgccttgttcattttgttagccttggccccgngctggtcttgggccac

SEQ ID NO: 3443 - DNA, 469 bp, Artificial; identical to SEQ ID NO: 3378
  TaSBEIIa-D allele with mutations introduced by TALEN pair TaSBEIIa_T03

SEQ ID NO: 3444 - DNA, 479 bp, Artificial; identical to SEQ ID NO: 3326
  TaSBEIIa-D allele with mutations introduced by TALEN pair TaSBEIIa_T03

SEQ ID NO: 3445 - DNA, 480 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3446 - DNA, 496 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaggccacaaaaggccggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttg

SEQ ID NO: 3447 - DNA, 442 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 3448 - DNA, 482 bp, Artificial; identical to SEQ ID NO: 3298
  TaSBEIIa-D allele with mutations introduced by TALEN pair TaSBEIIa_T03

SEQ ID NO: 3449 - DNA, 484 bp, Artificial; identical to SEQ ID NO: 3242
  TaSBEIIa-D allele with mutations introduced by TALEN pair TaSBEIIa_T03

SEQ ID NO: 3450 - DNA, 469 bp, Artificial; identical to SEQ ID NO: 3440
  TaSBEIIa-D allele with mutations introduced by TALEN pair TaSBEIIa_T03

SEQ ID NO: 3451 - DNA, 479 bp, Artificial; identical to SEQ ID NO: 3308
  TaSBEIIa-D allele with mutations introduced by TALEN pair TaSBEIIa_T03

SEQ ID NO: 3452 - DNA, 453 bp, Artificial
  TaSBEIIa-D allele with mutations introduced by TALEN pair TaSBEIIa_T03
gagatagctggattaggcgatcgcgcttcctgaacctgtattttttccccgcggggaaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3453 - DNA, 481 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3454 - DNA, 425 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3455 - DNA, 478 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgtctggctcttgggccactgaa

SEQ ID NO: 3456 - DNA, 484 bp, Artificial; identical to SEQ ID NO: 3242
  TaSBEIIa-D allele with mutations introduced by TALEN pair TaSBEIIa_T03

SEQ ID NO: 3457 - DNA, 484 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3458 - DNA, 484 bp, Artificial; identical to SEQ ID NO: 3242
  TaSBEIIa-D allele with mutations introduced by TALEN pair TaSBEIIa_T03

SEQ ID NO: 3459 - DNA, 614 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagccccgacaccgccaacacccgctgaaggtcctggtgcctgacggcgagagcgacgactttgggcaaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccgtgctggctcttgggccactgaa

SEQ ID NO: 3460 - DNA, 493 bp, Artificial
  TaSBEIIa-D allele with mutations introduced by TALEN pair TaSBEIIa_T03
  misc_feature (411): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgttattcacttnccaaatgccggatgaaaccaaccacggatgcgtcaggtttcgagcttcttctatcagcattgtgcagtactgcactgccttg

SEQ ID NO: 3461 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgtgcagtttgttagctgtggccccgcgctggctcttgggccactgaa

SEQ ID NO: 3462 - DNA, 484 bp, Artificial; identical to SEQ ID NO: 3242
  TaSBEIIa-D allele with mutations introduced by TALEN pair TaSBEIIa_T03

SEQ ID NO: 3463 - DNA, 479 bp, Artificial; identical to SEQ ID NO: 3326
  TaSBEIIa-D allele with mutations introduced by TALEN pair TaSBEIIa_T03

SEQ ID NO: 3464 - DNA, 484 bp, Artificial; identical to SEQ ID NO: 3211
  TaSBEIIa-D allele with mutations introduced by TALEN pair TaSBEIIa_T03

SEQ ID NO: 3465 - DNA, 460 bp, Artificial
  TaSBEIIa-D allele with mutations introduced by TALEN pair TaSBEIIa_T03
  misc_feature (444): n is a or c or t or g
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactgccttgttcattttgttagccttggccccgngctggtcttgggccac

SEQ ID NO: 3466 - DNA, 456 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3467 - DNA, 505 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgattaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagccagcgcaacaggagaagatcaaaccgaaggtcctggtgcctgacggcgaagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctctt

SEQ ID NO: 3468 - DNA, 536 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaggccagcaaaaaggcccaggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 3469 - DNA, 483 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3470 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3471 - DNA, 453 bp, Artificial; identical to SEQ ID NO: 3266
  TaSBEIIa-D allele with mutations introduced by TALEN pair TaSBEIIa_T03

SEQ ID NO: 3472 - DNA, 478 bp, Artificial; identical to SEQ ID NO: 3422
  TaSBEIIa-D allele with mutations introduced by TALEN pair TaSBEIIa_T03

SEQ ID NO: 3473 - DNA, 441 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcctt

SEQ ID NO: 3474 - DNA, 483 bp, Artificial; identical to SEQ ID NO: 3279
  TaSBEIIa-D allele with mutations introduced by TALEN pair TaSBEIIa_T03

SEQ ID NO: 3475 - DNA, 483 bp, Artificial; identical to SEQ ID NO: 3279
  TaSBEIIa-D allele with mutations introduced by TALEN pair TaSBEIIa_T03

SEQ ID NO: 3476 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3477 - DNA, 416 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttca

SEQ ID NO: 3478 - DNA, 447 bp, Artificial
  TaSBEIIa-D allele with mutations introduced by TALEN pair TaSBEIIa_T03
gagatagctggattaggcgatcgcgcttcctgaacctgtatttttcccgcggacgatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3479 - DNA, 465 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 3480 - DNA, 453 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgc

SEQ ID NO: 3481 - DNA, 453 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctctgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagcattgtgcagtactgcactgccttgttcattttgttagccttggccccgtgctggc

SEQ ID NO: 3482 - DNA, 484 bp, Artificial; identical to SEQ ID NO: 3242
  TaSBEIIa-D allele with mutations introduced by TALEN pair TaSBEIIa_T03

SEQ ID NO: 3483 - DNA, 524 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggcccgtgctggctc

SEQ ID NO: 3484 - DNA, 481 bp, Artificial; identical to SEQ ID NO: 3336
  TaSBEIIa-D allele with mutations introduced by TALEN pair TaSBEIIa_T03

SEQ ID NO: 3485 - DNA, 477 bp, Artificial; identical to SEQ ID NO: 3435
  TaSBEIIa-D allele with mutations introduced by TALEN pair TaSBEIIa_T03

SEQ ID NO: 3486 - DNA, 484 bp, Artificial; identical to SEQ ID NO: 3242
  TaSBEIIa-D allele with mutations introduced by TALEN pair TaSBEIIa_T03

SEQ ID NO: 3487 - DNA, 479 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccacctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3488 - DNA, 479 bp, Artificial
  TaSBEIIa-D allele with mutations introduced by TALEN pair TaSBEIIa_T03
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3489 - DNA, 479 bp, Artificial; identical to SEQ ID NO: 3423
  TaSBEIIa-D allele with mutations introduced by TALEN pair TaSBEIIa_T03

SEQ ID NO: 3490 - DNA, 457 bp, Artificial; identical to SEQ ID NO: 3244
  TaSBEIIa-D allele with mutations introduced by TALEN pair TaSBEIIa_T03

SEQ ID NO: 3491 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcagcctctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3492 - DNA, 485 bp, Artificial; identical to SEQ ID NO: 3316
  TaSBEIIa-D allele with mutations introduced by TALEN pair TaSBEIIa_T03

SEQ ID NO: 3493 - DNA, 481 bp, Artificial; identical to SEQ ID NO: 3387
  TaSBEIIa-D allele with mutations introduced by TALEN pair TaSBEIIa_T03

SEQ ID NO: 3494 - DNA, 483 bp, Artificial; identical to SEQ ID NO: 3279
  TaSBEIIa-D allele with mutations introduced by TALEN pair TaSBEIIa_T03

SEQ ID NO: 3495 - DNA, 537 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcacgacggccagtgaattcgagctcggtacctcgcgaatgcatctagatccatgcttccggctcgtatgttgtgtggaggtcctggtgcctgacggcgagagcgacgacttggcaagtccggcgcaacctgaagaattacaggtacacacactcgtgccggtaaatcttcatacaatcggttattcacttacccaaaatgccgggatgaaaaccaaccacggatgcgtcaggttttcgagcttcttctacagcattgtgcagtactgcactgccttgttcatttttgttagccttgg

SEQ ID NO: 3496 - DNA, 484 bp, Artificial; identical to SEQ ID NO: 3242
  TaSBEIIa-D allele with mutations introduced by TALEN pair TaSBEIIa_T03

SEQ ID NO: 3497 - DNA, 461 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaatcttcatacaatcgttattcacttaccaaaatgccggatgaaaccaaccacggatgcgtcaggttttcgagcttcttctatcagcattgtgcagtactgcactgccttgttcattttgttagccttggccccgtgctggtcttgggccac

SEQ ID NO: 3498 - DNA, 469 bp, Artificial; identical to SEQ ID NO: 3378
  TaSBEIIa-D allele with mutations introduced by TALEN pair TaSBEIIa_T03

SEQ ID NO: 3499 - DNA, 482 bp, Artificial; identical to SEQ ID NO: 3313
  TaSBEIIa-D allele with mutations introduced by TALEN pair TaSBEIIa_T03

SEQ ID NO: 3500 - DNA, 460 bp, Artificial
  TaSBEIIa-D allele with mutations introduced by TALEN pair TaSBEIIa_T03
gagatagctggattaggcgatcgcgcttcctgaacctgtattttttccccgcgggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcgtccggcgagagcgacgacttggcaagtccggcgcaacctgaagaattacaggtacacacactcgtgccggtaatcttcatacaatcgttattcacttaccaaatgccggatgaaaccaaccacggatgcgtcaggttttcgagcttcttctacagcattgtgcagtactgcactgccttgttcatttttgttagccttggcccccggctggtcttgggccac

SEQ ID NO: 3501 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3502 - DNA, 484 bp, Artificial; identical to SEQ ID NO: 3242
  TaSBEIIa-D allele with mutations introduced by TALEN pair TaSBEIIa_T03

SEQ ID NO: 3503 - DNA, 450 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcc

SEQ ID NO: 3504 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3505 - DNA, 511 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcccggagcaggtggtggccatcgccagccacgatggcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggtgcgtcaggttttcgagcttcttctatcagcattgtgcagtactgcactgccttgttcatttttgttagccttggccccgtgctggc

SEQ ID NO: 3506 - DNA, 479 bp, Artificial; identical to SEQ ID NO: 3428
  TaSBEIIa-D allele with mutations introduced by TALEN pair TaSBEIIa_T03

SEQ ID NO: 3507 - DNA, 520 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcccggagcaggtggtggccatcgccagccacgatggcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggca

SEQ ID NO: 3508 - DNA, 442 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 3509 - DNA, 440 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcaacctgaagaattacaggtacacacactcgtgccggtaaatcttctacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 3510 - DNA, 484 bp, Artificial; identical to SEQ ID NO: 3239
  TaSBEIIa-D allele with mutations introduced by TALEN pair TaSBEIIa_T03

SEQ ID NO: 3511 - DNA, 411 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcacgacggccagtgaattcgagctcggtacctcgcgaatgcatctagatccatgcttccggctcgtatgttgtgtggaggtcctggtgcctgacggcgagagcgacgacttggcaagtccggcgcaacctgaagaattacaggtacacacactcgtgccggtaaatcttca

SEQ ID NO: 3512 - DNA, 482 bp, Artificial; identical to SEQ ID NO: 3313
  TaSBEIIa-D allele with mutations introduced by TALEN pair TaSBEIIa_T03

SEQ ID NO: 3513 - DNA, 454 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 3514 - DNA, 455 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggc

SEQ ID NO: 3515 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3516 - DNA, 484 bp, Artificial
  TaSBEIIa-D allele with mutations introduced by TALEN pair TaSBEIIa_T03
gagatagctggattaggcgatcgcgcttcctgaacctgtattttttcccgcgggaacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3517 - DNA, 459 bp, Artificial
  TaSBEIIa-D allele with mutations introduced by TALEN pair TaSBEIIa_T03
gagatagctggattaggcgatcgcgcttcctgaacctgtattttttcccgcgggaacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccg

SEQ ID NO: 3518 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttggaccactgaa

SEQ ID NO: 3519 - DNA, 483 bp, Artificial; identical to SEQ ID NO: 3279
  TaSBEIIa-D allele with mutations introduced by TALEN pair TaSBEIIa_T03

SEQ ID NO: 3520 - DNA, 479 bp, Artificial; identical to SEQ ID NO: 3428
  TaSBEIIa-D allele with mutations introduced by TALEN pair TaSBEIIa_T03

SEQ ID NO: 3521 - DNA, 470 bp, Artificial; identical to SEQ ID NO: 3320
  TaSBEIIa-D allele with mutations introduced by TALEN pair TaSBEIIa_T03

SEQ ID NO: 3522 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3523 - DNA, 483 bp, Artificial; identical to SEQ ID NO: 3279
  TaSBEIIa-D allele with mutations introduced by TALEN pair TaSBEIIa_T03

SEQ ID NO: 3524 - DNA, 470 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccact

SEQ ID NO: 3525 - DNA, 484 bp, Artificial; identical to SEQ ID NO: 3242
  TaSBEIIa-D allele with mutations introduced by TALEN pair TaSBEIIa_T03

SEQ ID NO: 3526 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3527 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccgaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3528 - DNA, 438 bp, Artificial
  TaSBEIIa-D allele with mutations introduced by TALEN pair TaSBEIIa_T03
gagatagctggattaggcgatcgcgcttcctgaacctgtatttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaatgccggatgaaaccaaccacggattgcgtcaggtttcgagcttcttctacagcattgtgcagtactgcactgccttgttcattttgttagccttggccccggctgg

SEQ ID NO: 3529 - DNA, 538 bp, Artificial
  TaSBEIIa-D allele with mutations introduced by TALEN pair TaSBEIIa_T03
gagatagctggattaggcgatcgcgcttcctgaacctgtattttttccccgctggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttccggttcccaacgatcaaggcgagttacaccgaactgagatacctacagcgtgagctaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactg

SEQ ID NO: 3530 - DNA, 484 bp, Artificial; identical to SEQ ID NO: 3239
  TaSBEIIa-D allele with mutations introduced by TALEN pair TaSBEIIa_T03

SEQ ID NO: 3531 - DNA, 457 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcactttaccaaaatgccggatgaaaccaaccacggatgcgtcaggtttcgagcttcttctatcagcattgtgcagtactgcactgccttgttcattttgttagccttggccccgtgct

SEQ ID NO: 3532 - DNA, 459 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctcccctggtgcctgacggcgagagcgacgactttgggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3533 - DNA, 461 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacaccgtcgtgccggaaaatcttcatgcacccgttattcaacttaccaaatatcggatgaaccaagccgcggcggcatcaggtttcaagcttcttctatcagcattgtgcactacttcactgccttgtgcagtttgttagctgtggccccg

SEQ ID NO: 3534 - DNA, 467 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3535 - DNA, 466 bp, Artificial
  TaSBEIIa-D allele with mutations introduced by TALEN pair TaSBEIIa_T03
gagatagctggattaggcgatcgcgcttcctgaacctgtattttttcccgcggagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3536 - DNA, 479 bp, Artificial; identical to SEQ ID NO: 3326
  TaSBEIIa-D allele with mutations introduced by TALEN pair TaSBEIIa_T03

SEQ ID NO: 3537 - DNA, 456 bp, Artificial; identical to SEQ ID NO: 3466
  TaSBEIIa-D allele with mutations introduced by TALEN pair TaSBEIIa_T03

SEQ ID NO: 3538 - DNA, 479 bp, Artificial; identical to SEQ ID NO: 3326
  TaSBEIIa-D allele with mutations introduced by TALEN pair TaSBEIIa_T03

SEQ ID NO: 3539 - DNA, 482 bp, Artificial; identical to SEQ ID NO: 3313
  TaSBEIIa-D allele with mutations introduced by TALEN pair TaSBEIIa_T03

SEQ ID NO: 3540 - DNA, 483 bp, Artificial; identical to SEQ ID NO: 3279
  TaSBEIIa-D allele with mutations introduced by TALEN pair TaSBEIIa_T03

SEQ ID NO: 3541 - DNA, 438 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccggcgagagcgacgacttggcaagtccggcgcacctgaagaattacaggtacacacactcgtgccggtaaatcttctacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 3542 - DNA, 473 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3543 - DNA, 455 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 3544 - DNA, 484 bp, Artificial; identical to SEQ ID NO: 3240
  TaSBEIIa-D allele with mutations introduced by TALEN pair TaSBEIIa_T03

SEQ ID NO: 3545 - DNA, 479 bp, Artificial; identical to SEQ ID NO: 3428
  TaSBEIIa-D allele with mutations introduced by TALEN pair TaSBEIIa_T03

SEQ ID NO: 3546 - DNA, 484 bp, Artificial; identical to SEQ ID NO: 3242
  TaSBEIIa-D allele with mutations introduced by TALEN pair TaSBEIIa_T03

SEQ ID NO: 3547 - DNA, 543 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatacgtttggaactgacagaaccgcaacgttgaaggagccactcagccgcgggtttctggagttaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccact

SEQ ID NO: 3548 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaatcgttattcactttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3549 - DNA, 484 bp, Artificial; identical to SEQ ID NO: 3242
  TaSBEIIa-D allele with mutations introduced by TALEN pair TaSBEIIa_T03

SEQ ID NO: 3550 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaatgttgtggcgtttttcactattgtagtcatccttgcattttgcaggcgccgtcctgagccgcgcggcctctccaaggtcctggtgcctgacggcgagagcgacgatcttggccaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3551 - DNA, 471 bp, Artificial
  TaSBEIIa-D allele with mutations introduced by TALEN pair TaSBEIIa_T03
gagatagctggattaggcgatcgcgcttcctgaacctgtattttttcccgctgggaacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgctgctggctcttgggccactgaa

SEQ ID NO: 3552 - DNA, 484 bp, Artificial; identical to SEQ ID NO: 3211
  TaSBEIIa-D allele with mutations introduced by TALEN pair TaSBEIIa_T03

SEQ ID NO: 3553 - DNA, 421 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggattgcgtcaggtttcgagcttcttctacagcattgtgcagtactgcactgccttg

SEQ ID NO: 3554 - DNA, 482 bp, Artificial; identical to SEQ ID NO: 3313
  TaSBEIIa-D allele with mutations introduced by TALEN pair TaSBEIIa_T03

SEQ ID NO: 3555 - DNA, 484 bp, Artificial; identical to SEQ ID NO: 3239
  TaSBEIIa-D allele with mutations introduced by TALEN pair TaSBEIIa_T03

SEQ ID NO: 3556 - DNA, 481 bp, Artificial; identical to SEQ ID NO: 3336
  TaSBEIIa-D allele with mutations introduced by TALEN pair TaSBEIIa_T03

SEQ ID NO: 3557 - DNA, 482 bp, Artificial; identical to SEQ ID NO: 3313
  TaSBEIIa-D allele with mutations introduced by TALEN pair TaSBEIIa_T03

SEQ ID NO: 3558 - DNA, 479 bp, Artificial; identical to SEQ ID NO: 3371
  TaSBEIIa-D allele with mutations introduced by TALEN pair TaSBEIIa_T03

SEQ ID NO: 3559 - DNA, 482 bp, Artificial; identical to SEQ ID NO: 3313
  TaSBEIIa-D allele with mutations introduced by TALEN pair TaSBEIIa_T03

SEQ ID NO: 3560 - DNA, 477 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcccgagccgcgcggcctctccagtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgtctggctcttgggccactgaa

SEQ ID NO: 3561 - DNA, 482 bp, Artificial; identical to SEQ ID NO: 3313
  TaSBEIIa-D allele with mutations introduced by TALEN pair TaSBEIIa_T03

SEQ ID NO: 3562 - DNA, 483 bp, Artificial; identical to SEQ ID NO: 3279
  TaSBEIIa-D allele with mutations introduced by TALEN pair TaSBEIIa_T03

SEQ ID NO: 3563 - DNA, 514 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcccggagcaggtggtggccatcgccagccacgatggcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 3564 - DNA, 536 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagacggtgcaggcgctgttgccggtgctgtgccaggcccacggctttgaccccggagcaggtggtggccatcgccagccacgatggcggcaagcaaggtcctggtgcctgacggcgagagcgacgacttggcaagtccggcgcacctgagaattacagggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 3565 - DNA, 485 bp, Artificial; identical to SEQ ID NO: 3379
  TaSBEIIa-D allele with mutations introduced by TALEN pair TaSBEIIa_T03

SEQ ID NO: 3566 - DNA, 482 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3567 - DNA, 455 bp, Artificial
  TaSBEIIa-D allele with mutations introduced by TALEN pair TaSBEIIa_T03
gagatagctggattaggcgatcgcgcttcctgaacctgtatttttcccgctggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcctgtcctgagccgcgcggcctctccggcgagagcgacgacttggcaagtccggcgcaacctgaagaattacggtacacacactcgtgccgtaaatcttcatacaatcgttattcacttaccaaaatgccggatgaaaccaaccacggatgcgtcaggttttcgagcttcttctacagcaattgtgcagtactgcactgccttgtcattttgttagctggccccggctgtcttgggccac

SEQ ID NO: 3568 - DNA, 476 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3569 - DNA, 409 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaatcttcatacaatcgttattcacttaccaaatgccggatgaaaccaaccacggatgcgtcaggtttcgagcttcttctacagcattgtgcagtactgcactgccttg

SEQ ID NO: 3570 - DNA, 484 bp, Artificial; identical to SEQ ID NO: 3242
  TaSBEIIa-D allele with mutations introduced by TALEN pair TaSBEIIa_T03

SEQ ID NO: 3571 - DNA, 484 bp, Artificial; identical to SEQ ID NO: 3242
  TaSBEIIa-D allele with mutations introduced by TALEN pair TaSBEIIa_T03

SEQ ID NO: 3572 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3573 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3574 - DNA, 461 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagcttggccccgtgctggtcttgggccac

SEQ ID NO: 3575 - DNA, 484 bp, Artificial; identical to SEQ ID NO: 3526
  TaSBEIIa-D allele with mutations introduced by TALEN pair TaSBEIIa_T03

SEQ ID NO: 3576 - DNA, 479 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3577 - DNA, 484 bp, Artificial; identical to SEQ ID NO: 3242
  TaSBEIIa-D allele with mutations introduced by TALEN pair TaSBEIIa_T03

SEQ ID NO: 3578 - DNA, 482 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaccaaccacggatgcgtcaggtttcgagcttcttctatcagcattgtgcagtactgcactgccttgttcattttgttagccttggccccgtgctggctcttgggccactgaa

SEQ ID NO: 3579 - DNA, 485 bp, Artificial; identical to SEQ ID NO: 3316
  TaSBEIIa-D allele with mutations introduced by TALEN pair TaSBEIIa_T03

SEQ ID NO: 3580 - DNA, 470 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 3581 - DNA, 456 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggc

SEQ ID NO: 3582 - DNA, 478 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtctggtgctgacggcgagagcgacgacttggcaagtccgcgcacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3583 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3584 - DNA, 484 bp, Artificial; identical to SEQ ID NO: 3242
  TaSBEIIa-D allele with mutations introduced by TALEN pair TaSBEIIa_T03

SEQ ID NO: 3585 - DNA, 469 bp, Artificial; identical to SEQ ID NO: 3440
  TaSBEIIa-D allele with mutations introduced by TALEN pair TaSBEIIa_T03

SEQ ID NO: 3586 - DNA, 424 bp, Artificial
  TaSBEIIa-D allele with mutations introduced by TALEN pair TaSBEIIa_T03
gagatagctggattaggcgatcgcgcttcctgaacctgtattttttccccgcgggaatgcgttagtgtcacccaggccctggtgttaccacggctttgatcattcctcgtttcattctgatatatattttctcactctttttcttcctgttcttgctgtaactgcaagttgtggcgttttttcacttattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgcccgggatgaaaccaaccacggattgcgtcaggttttcgagcttcttcttacagcattgtgcagtactgcactgccttg

SEQ ID NO: 3587 - DNA, 406 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcaacctgaagaattacaggtacacacactcgtgccggtaaatcttctacaatcgttattcacttaccaaatgccggatgaaaccaaccacggatgcgtcaggtttcgagcttcttctatcagcattgtgcagtactgcactgccttg

SEQ ID NO: 3588 - DNA, 484 bp, Artificial; identical to SEQ ID NO: 3242
  TaSBEIIa-D allele with mutations introduced by TALEN pair TaSBEIIa_T03

SEQ ID NO: 3589 - DNA, 485 bp, Artificial; identical to SEQ ID NO: 3379
  TaSBEIIa-D allele with mutations introduced by TALEN pair TaSBEIIa_T03

SEQ ID NO: 3590 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3591 - DNA, 521 bp, Artificial
  TaSBEIIa-D allele with mutations introduced by TALEN pair TaSBEIIa_T03
  misc_feature (461): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcccggagcaggtggtggccatcgccagccacgatggcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacgggatgcgtcggttttcgagcttcttctatcagcattgngcagtactgcactgccttgttcatttttgttagccttggccccgtgctggctctgggcca

SEQ ID NO: 3592 - DNA, 480 bp, Artificial; identical to SEQ ID NO: 3348
  TaSBEIIa-D allele with mutations introduced by TALEN pair TaSBEIIa_T03

SEQ ID NO: 3593 - DNA, 484 bp, Artificial; identical to SEQ ID NO: 3242
  TaSBEIIa-D allele with mutations introduced by TALEN pair TaSBEIIa_T03

SEQ ID NO: 3594 - DNA, 484 bp, Artificial; identical to SEQ ID NO: 3400
  TaSBEIIa-D allele with mutations introduced by TALEN pair TaSBEIIa_T03

SEQ ID NO: 3595 - DNA, 484 bp, Artificial; identical to SEQ ID NO: 3242
  TaSBEIIa-D allele with mutations introduced by TALEN pair TaSBEIIa_T03

SEQ ID NO: 3596 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaagtgcgttagtgtcacccaggccctggtgttaccacggctttgatcattcctcgtttcattctgatatatattttctcactctttttcttcctgttcctgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3597 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccact

SEQ ID NO: 3598 - DNA, 461 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgcctgtcctgagccgcgcggcctctggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3599 - DNA, 479 bp, Artificial; identical to SEQ ID NO: 3428
  TaSBEIIa-D allele with mutations introduced by TALEN pair TaSBEIIa_T03

SEQ ID NO: 3600 - DNA, 478 bp, Artificial; identical to SEQ ID NO: 3395
  TaSBEIIa-D allele with mutations introduced by TALEN pair TaSBEIIa_T03

SEQ ID NO: 3601 - DNA, 484 bp, Artificial; identical to SEQ ID NO: 3400
  TaSBEIIa-D allele with mutations introduced by TALEN pair TaSBEIIa_T03

SEQ ID NO: 3602 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3603 - DNA, 477 bp, Artificial; identical to SEQ ID NO: 3435
  TaSBEIIa-D allele with mutations introduced by TALEN pair TaSBEIIa_T03

SEQ ID NO: 3604 - DNA, 481 bp, Artificial
  TaSBEIIa-D allele with mutations introduced by TALEN pair TaSBEIIa_T03
gagatagctggattaggcgatcgcgcttcctgaacctgtatttttccccgcggggaaatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3605 - DNA, 479 bp, Artificial; identical to SEQ ID NO: 3326
  TaSBEIIa-D allele with mutations introduced by TALEN pair TaSBEIIa_T03

SEQ ID NO: 3606 - DNA, 517 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcccggagcaggtggtggccatcgccagccacgatggcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgg

SEQ ID NO: 3607 - DNA, 481 bp, Artificial; identical to SEQ ID NO: 3286
  TaSBEIIa-D allele with mutations introduced by TALEN pair TaSBEIIa_T03

SEQ ID NO: 3608 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcacctgaagaattacaggtacacacactcgtgccggtaaatcttcatacaatcgttattcacttaccaaatgccggatgaaccaaccacggatgcgtcaggtttcgagcttcttctatcagcattgtgcagtactgcactgccttgttcattttgttagccttggccccgtgctggctcttgggccactgaa

SEQ ID NO: 3609 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3610 - DNA, 483 bp, Artificial; identical to SEQ ID NO: 3279
  TaSBEIIa-D allele with mutations introduced by TALEN pair TaSBEIIa_T03

SEQ ID NO: 3611 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggctttgtttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3612 - DNA, 470 bp, Artificial; identical to SEQ ID NO: 3320
  TaSBEIIa-D allele with mutations introduced by TALEN pair TaSBEIIa_T03

SEQ ID NO: 3613 - DNA, 473 bp, Artificial; identical to SEQ ID NO: 3542
  TaSBEIIa-D allele with mutations introduced by TALEN pair TaSBEIIa_T03

SEQ ID NO: 3614 - DNA, 466 bp, Artificial; identical to SEQ ID NO: 3409
  TaSBEIIa-D allele with mutations introduced by TALEN pair TaSBEIIa_T03

SEQ ID NO: 3615 - DNA, 483 bp, Artificial; identical to SEQ ID NO: 3279
  TaSBEIIa-D allele with mutations introduced by TALEN pair TaSBEIIa_T03

SEQ ID NO: 3616 - DNA, 524 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgactggtgagtactcaaccaagtcattctgagaatagtcagcatgttcactacggaacaagtcggaataaagctaagaaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 3617 - DNA, 480 bp, Artificial; identical to SEQ ID NO: 3284
  TaSBEIIa-D allele with mutations introduced by TALEN pair TaSBEIIa_T03

SEQ ID NO: 3618 - DNA, 484 bp, Artificial; identical to SEQ ID NO: 3242
  TaSBEIIa-D allele with mutations introduced by TALEN pair TaSBEIIa_T03

SEQ ID NO: 3619 - DNA, 480 bp, Artificial; identical to SEQ ID NO: 3284
  TaSBEIIa-D allele with mutations introduced by TALEN pair TaSBEIIa_T03

SEQ ID NO: 3620 - DNA, 517 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtccccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcccggagcaggtggtggccatcgccagccacgatggcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttggg

SEQ ID NO: 3621 - DNA, 481 bp, Artificial; identical to SEQ ID NO: 3336
  TaSBEIIa-D allele with mutations introduced by TALEN pair TaSBEIIa_T03

SEQ ID NO: 3622 - DNA, 483 bp, Artificial; identical to SEQ ID NO: 3279
  TaSBEIIa-D allele with mutations introduced by TALEN pair TaSBEIIa_T03

SEQ ID NO: 3623 - DNA, 482 bp, Artificial
  TaSBEIIa-D allele with mutations introduced by TALEN pair TaSBEIIa_T03
gagatagctggattaggcgatcgcgcttcctgaacctgtattttttccccgcgggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3624 - DNA, 467 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3625 - DNA, 483 bp, Artificial; identical to SEQ ID NO: 3363
  TaSBEIIa-D allele with mutations introduced by TALEN pair TaSBEIIa_T03

SEQ ID NO: 3626 - DNA, 484 bp, Artificial; identical to SEQ ID NO: 3242
  TaSBEIIa-D allele with mutations introduced by TALEN pair TaSBEIIa_T03

SEQ ID NO: 3627 - DNA, 484 bp, Artificial; identical to SEQ ID NO: 3242
  TaSBEIIa-D allele with mutations introduced by TALEN pair TaSBEIIa_T03

SEQ ID NO: 3628 - DNA, 481 bp, Artificial; identical to SEQ ID NO: 3573
  TaSBEIIa-D allele with mutations introduced by TALEN pair TaSBEIIa_T03

SEQ ID NO: 3629 - DNA, 471 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3630 - DNA, 483 bp, Artificial
  TaSBEIIa-D allele with mutations introduced by TALEN pair TaSBEIIa_T03
gagatagctggattaggcgatcgcgcttcctgaacctgtattttttccccgcgggaagatacgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3631 - DNA, 482 bp, Artificial; identical to SEQ ID NO: 3566
  TaSBEIIa-D allele with mutations introduced by TALEN pair TaSBEIIa_T03

SEQ ID NO: 3632 - DNA, 553 bp, Artificial
  TaSBEIIa-D allele with mutations introduced by TALEN pair TaSBEIIa_T03
  misc_feature (424): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaggtagctcttgatccggcaaacaaaccaccgcgccttgcagcacatccccttcgccagctggcgtatagcgaaaggtcctggtgcctgacggcgagagcgacgacttggcaagtccggcgcaacctgaagaattacaggtacacacactcgtgccggtaaatcttcatacaatcgttattcncttaccaaatgccggtgaaaccaccacggatgcgtcaggtttcgagcttcttctacagcattgtgcagtactgcactgccttgttcattttgttagccttggccccgtgctggctcttgggccactgaa

SEQ ID NO: 3633 - DNA, 484 bp, Artificial; identical to SEQ ID NO: 3242
  TaSBEIIa-D allele with mutations introduced by TALEN pair TaSBEIIa_T03

SEQ ID NO: 3634 - DNA, 465 bp, Artificial
  TaSBEIIa-D allele with mutations introduced by TALEN pair TaSBEIIa_T03
gagatagctggattaggcgatcgcgcttcctgaacctgtattttttccccgcgggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3635 - DNA, 484 bp, Artificial; identical to SEQ ID NO: 3242
  TaSBEIIa-D allele with mutations introduced by TALEN pair TaSBEIIa_T03

SEQ ID NO: 3636 - DNA, 481 bp, Artificial; identical to SEQ ID NO: 3286
  TaSBEIIa-D allele with mutations introduced by TALEN pair TaSBEIIa_T03

SEQ ID NO: 3637 - DNA, 446 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccggcgagagcgacgacttggcaagtccggcgcacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcca

SEQ ID NO: 3638 - DNA, 441 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcaacctgaagaattacaggtacacacactcgtgccggtaaatcttctacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 3639 - DNA, 471 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3640 - DNA, 482 bp, Artificial; identical to SEQ ID NO: 3602
  TaSBEIIa-D allele with mutations introduced by TALEN pair TaSBEIIa_T03

SEQ ID NO: 3641 - DNA, 470 bp, Artificial; identical to SEQ ID NO: 3320
  TaSBEIIa-D allele with mutations introduced by TALEN pair TaSBEIIa_T03

SEQ ID NO: 3642 - DNA, 480 bp, Artificial; identical to SEQ ID NO: 3348
  TaSBEIIa-D allele with mutations introduced by TALEN pair TaSBEIIa_T03

SEQ ID NO: 3643 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3644 - DNA, 483 bp, Artificial; identical to SEQ ID NO: 3279
  TaSBEIIa-D allele with mutations introduced by TALEN pair TaSBEIIa_T03

SEQ ID NO: 3645 - DNA, 484 bp, Artificial; identical to SEQ ID NO: 3242
  TaSBEIIa-D allele with mutations introduced by TALEN pair TaSBEIIa_T03

SEQ ID NO: 3646 - DNA, 451 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 3647 - DNA, 480 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3648 - DNA, 415 bp, Artificial
  TaSBEIIa-D allele with mutations introduced by TALEN pair TaSBEIIa_T03
gagatagctggattaggcgatcgcgcttcctgaacctgtattttttccccgcgggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgcaccggataaggcgcagcggtcgggctgaacgggggttgcggcgatctcgatcagctcgatgtacaaggtcctggtgcctgacggcgagagcgacgacttggcaagtccggcgc

SEQ ID NO: 3649 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgctcctgagccgcgcggcctctcccctggtgcctgacggcgagagcgacgacttggcaagtccggcgcaacctgaagaattacaggtacacacactcgtgccggtaaatcttcatacaatcgttattcactttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3650 - DNA, 484 bp, Artificial; identical to SEQ ID NO: 3239
  TaSBEIIa-D allele with mutations introduced by TALEN pair TaSBEIIa_T03

SEQ ID NO: 3651 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgaacattcctcgtttcattctgatatatattttctcactctttttcttcctgttcttgctgtaactgcaagttgtggcgttttttcactattgtagtcatccttgcattttgcaggcgccgtcctgagccgcgcggcctctcccctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3652 - DNA, 484 bp, Artificial; identical to SEQ ID NO: 3242
  TaSBEIIa-D allele with mutations introduced by TALEN pair TaSBEIIa_T03

SEQ ID NO: 3653 - DNA, 483 bp, Artificial; identical to SEQ ID NO: 3280
  TaSBEIIa-D allele with mutations introduced by TALEN pair TaSBEIIa_T03

SEQ ID NO: 3654 - DNA, 443 bp, Artificial
  TaSBEIIa-D allele with mutations introduced by TALEN pair TaSBEIIa_T03
gagatagctggattaggcgatcgcgcttcctgaacctgtattttttcccgcgggaacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 3655 - DNA, 419 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaatcttcatacaatcgttattcacttaccaaatgccggatgaaaccaaccacggatgcgtcaggttttcgagcttcttctacagcattgtgcagtactgcactgccttg

SEQ ID NO: 3656 - DNA, 482 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccttctcggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3657 - DNA, 524 bp, Artificial
  TaSBEIIa-D allele with mutations introduced by TALEN pair TaSBEIIa_T03
  misc_feature (351): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccacgccacctctgacttgagcgtcgattttttgtgatgctcgtcaggggggcggagcctatggaaaaacgccagcaacgcggccttttttacggttcctggccttttgcnggccttttgcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttc

SEQ ID NO: 3658 - DNA, 455 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggc

SEQ ID NO: 3659 - DNA, 484 bp, Artificial; identical to SEQ ID NO: 3242
  TaSBEIIa-D allele with mutations introduced by TALEN pair TaSBEIIa_T03

SEQ ID NO: 3660 - DNA, 480 bp, Artificial; identical to SEQ ID NO: 3284
  TaSBEIIa-D allele with mutations introduced by TALEN pair TaSBEIIa_T03

SEQ ID NO: 3661 - DNA, 484 bp, Artificial; identical to SEQ ID NO: 3242
  TaSBEIIa-D allele with mutations introduced by TALEN pair TaSBEIIa_T03

SEQ ID NO: 3662 - DNA, 484 bp, Artificial; identical to SEQ ID NO: 3400
  TaSBEIIa-D allele with mutations introduced by TALEN pair TaSBEIIa_T03

SEQ ID NO: 3663 - DNA, 479 bp, Artificial; identical to SEQ ID NO: 3371
  TaSBEIIa-D allele with mutations introduced by TALEN pair TaSBEIIa_T03

SEQ ID NO: 3664 - DNA, 478 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3665 - DNA, 479 bp, Artificial; identical to SEQ ID NO: 3326
  TaSBEIIa-D allele with mutations introduced by TALEN pair TaSBEIIa_T03

SEQ ID NO: 3666 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcactttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3667 - DNA, 546 bp, Artificial
  TaSBEIIa-D allele with mutations introduced by TALEN pair TaSBEIIa_T03
  misc_feature (427): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtagctcttgatccggcaaacaaaccaccgcgccttgcagcacatccccctttcgccagctggcgtatagcgaaaggtcctggtgcctgacggcgagagcgacgacttggcaagtccggcgcaacctgaagaattacaggtacacacactcgtgccggtaaatcttcatacaatcgttattcncttaccaaatgccggtgaaaccaaccacggatgcgtcaggtttcgagcttcttctatcagcattgtgcagtactgcactgccttgttcattttgttagccttggcccgtgctggctctt

SEQ ID NO: 3668 - DNA, 479 bp, Artificial; identical to SEQ ID NO: 3326
  TaSBEIIa-D allele with mutations introduced by TALEN pair TaSBEIIa_T03

SEQ ID NO: 3669 - DNA, 484 bp, Artificial; identical to SEQ ID NO: 3400
  TaSBEIIa-D allele with mutations introduced by TALEN pair TaSBEIIa_T03

SEQ ID NO: 3670 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgactttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3671 - DNA, 545 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatacgtttggaactgacagaaccgcaacgttgaaggagccactcagccgcgggtttctggagttaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 3672 - DNA, 471 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgctgctggctcttgggccactgaa

SEQ ID NO: 3673 - DNA, 481 bp, Artificial; identical to SEQ ID NO: 3504
  TaSBEIIa-D allele with mutations introduced by TALEN pair TaSBEIIa_T03

SEQ ID NO: 3674 - DNA, 483 bp, Artificial; identical to SEQ ID NO: 3279
  TaSBEIIa-D allele with mutations introduced by TALEN pair TaSBEIIa_T03

SEQ ID NO: 3675 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3676 - DNA, 483 bp, Artificial; identical to SEQ ID NO: 3238
  TaSBEIIa-D allele with mutations introduced by TALEN pair TaSBEIIa_T03

SEQ ID NO: 3677 - DNA, 460 bp, Artificial; identical to SEQ ID NO: 3300
  TaSBEIIa-D allele with mutations introduced by TALEN pair TaSBEIIa_T03
  misc_feature (444): n is a or c or t or g

SEQ ID NO: 3678 - DNA, 483 bp, Artificial
  TaSBEIIa-D allele with mutations introduced by TALEN pair TaSBEIIa_T03
gagatagctggattaggcgatcgcgcttcctgaacctgtattttttccccgctggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3679 - DNA, 483 bp, Artificial; identical to SEQ ID NO: 3279
  TaSBEIIa-D allele with mutations introduced by TALEN pair TaSBEIIa_T03

SEQ ID NO: 3680 - DNA, 483 bp, Artificial; identical to SEQ ID NO: 3436
  TaSBEIIa-D allele with mutations introduced by TALEN pair TaSBEIIa_T03

SEQ ID NO: 3681 - DNA, 472 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttccgttcttgctgtaactgcaagttgtggcgtttttcactattgtagtcatccttgcattttgcaggcgccgtcctgagccgcgcggccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgtctggctcttgggccactg

SEQ ID NO: 3682 - DNA, 468 bp, Artificial; identical to SEQ ID NO: 3351
  TaSBEIIa-D allele with mutations introduced by TALEN pair TaSBEIIa_T03

SEQ ID NO: 3683 - DNA, 490 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaaggtcctggtgcctgacggcgagagcgacgacttggcaagtccggcgcaacctgaagaattacaggtacacacactcgtgccggtaaatcttcatacaatcgttattcacttaccaaaatgccgggatgaaaccaaccacggatgcgtcaggtttcgagcttcttctatcagcattgtgcagtactgcactg

SEQ ID NO: 3684 - DNA, 479 bp, Artificial; identical to SEQ ID NO: 3326
  TaSBEIIa-D allele with mutations introduced by TALEN pair TaSBEIIa_T03

SEQ ID NO: 3685 - DNA, 521 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattatcgcgcagaaaaaacaggaaggcaaaatgccgcaaaaaggggaaggtcctggtgcctgacggcgagagcgacgacttggcaagtccggcgcaacctgaagaattacaggtacacacactcgtgccggtaaatcttcatacaatcgttattcacttaccaaaatgccgggatgaaaccaaccacggatgcgtcaggtttcgagcttcttctatcagcattgtgcagtactgcactgccttgttcattttg

SEQ ID NO: 3686 - DNA, 482 bp, Artificial; identical to SEQ ID NO: 3313
  TaSBEIIa-D allele with mutations introduced by TALEN pair TaSBEIIa_T03

SEQ ID NO: 3687 - DNA, 484 bp, Artificial; identical to SEQ ID NO: 3239
  TaSBEIIa-D allele with mutations introduced by TALEN pair TaSBEIIa_T03

SEQ ID NO: 3688 - DNA, 580 bp, Artificial
  TaSBEIIa-D allele with mutations introduced by TALEN pair TaSBEIIa_T03
  misc_feature (504): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcaataatggtggcaagcaggcgctggagacggtccagcggctgttgccggtgctgtgccaggcccacggcttgaccccccagcaggtggtggcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcgaggtttcgagcttcttcnatcacattgtgcaggtactgcactgccttgttcattttgttagccttggccccgtgctggctcttgggccactgaa

SEQ ID NO: 3689 - DNA, 484 bp, Artificial; identical to SEQ ID NO: 3242
  TaSBEIIa-D allele with mutations introduced by TALEN pair TaSBEIIa_T03

SEQ ID NO: 3690 - DNA, 485 bp, Artificial; identical to SEQ ID NO: 3501
  TaSBEIIa-D allele with mutations introduced by TALEN pair TaSBEIIa_T03

SEQ ID NO: 3691 - DNA, 484 bp, Artificial; identical to SEQ ID NO: 3239
  TaSBEIIa-D allele with mutations introduced by TALEN pair TaSBEIIa_T03

SEQ ID NO: 3692 - DNA, 479 bp, Artificial; identical to SEQ ID NO: 3326
  TaSBEIIa-D allele with mutations introduced by TALEN pair TaSBEIIa_T03

SEQ ID NO: 3693 - DNA, 470 bp, Artificial; identical to SEQ ID NO: 3580
  TaSBEIIa-D allele with mutations introduced by TALEN pair TaSBEIIa_T03

SEQ ID NO: 3694 - DNA, 485 bp, Artificial; identical to SEQ ID NO: 3379
  TaSBEIIa-D allele with mutations introduced by TALEN pair TaSBEIIa_T03

SEQ ID NO: 3695 - DNA, 453 bp, Artificial; identical to SEQ ID NO: 3266
  TaSBEIIa-D allele with mutations introduced by TALEN pair TaSBEIIa_T03

SEQ ID NO: 3696 - DNA, 482 bp, Artificial; identical to SEQ ID NO: 3566
  TaSBEIIa-D allele with mutations introduced by TALEN pair TaSBEIIa_T03

SEQ ID NO: 3697 - DNA, 558 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggttgaaagcctcaacttgattcgcaacaaaaagatccgctctgatactccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3698 - DNA, 484 bp, Artificial; identical to SEQ ID NO: 3242
  TaSBEIIa-D allele with mutations introduced by TALEN pair TaSBEIIa_T03

SEQ ID NO: 3699 - DNA, 484 bp, Artificial; identical to SEQ ID NO: 3239
  TaSBEIIa-D allele with mutations introduced by TALEN pair TaSBEIIa_T03

SEQ ID NO: 3700 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccaagtgctggcgctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3701 - DNA, 465 bp, Artificial; identical to SEQ ID NO: 3479
  TaSBEIIa-D allele with mutations introduced by TALEN pair TaSBEIIa_T03

SEQ ID NO: 3702 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttgggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3703 - DNA, 483 bp, Artificial; identical to SEQ ID NO: 3279
  TaSBEIIa-D allele with mutations introduced by TALEN pair TaSBEIIa_T03

SEQ ID NO: 3704 - DNA, 441 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcaacctgaagaattacaggtacacacactcgtgccggtaaatcttctacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 3705 - DNA, 478 bp, Artificial; identical to SEQ ID NO: 3395
  TaSBEIIa-D allele with mutations introduced by TALEN pair TaSBEIIa_T03

SEQ ID NO: 3706 - DNA, 484 bp, Artificial; identical to SEQ ID NO: 3242
  TaSBEIIa-D allele with mutations introduced by TALEN pair TaSBEIIa_T03

SEQ ID NO: 3707 - DNA, 477 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactga

SEQ ID NO: 3708 - DNA, 439 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcactgaagaattacaggtacacacactcgtgccggtaaatcttctacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 3709 - DNA, 478 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggttcgttttttcactattgtagtcatcctttgcatttgcaggcgccgtcctgagccgcgcggcctctccagtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3710 - DNA, 484 bp, Artificial; identical to SEQ ID NO: 3242
  TaSBEIIa-D allele with mutations introduced by TALEN pair TaSBEIIa_T03

SEQ ID NO: 3711 - DNA, 484 bp, Artificial; identical to SEQ ID NO: 3242
  TaSBEIIa-D allele with mutations introduced by TALEN pair TaSBEIIa_T03

SEQ ID NO: 3712 - DNA, 485 bp, Artificial; identical to SEQ ID NO: 3316
  TaSBEIIa-D allele with mutations introduced by TALEN pair TaSBEIIa_T03

SEQ ID NO: 3713 - DNA, 453 bp, Artificial; identical to SEQ ID NO: 3266
  TaSBEIIa-D allele with mutations introduced by TALEN pair TaSBEIIa_T03

SEQ ID NO: 3714 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3715 - DNA, 482 bp, Artificial; identical to SEQ ID NO: 3313
  TaSBEIIa-D allele with mutations introduced by TALEN pair TaSBEIIa_T03

SEQ ID NO: 3716 - DNA, 462 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgcctgacggcgagagcgacgactttggcaagtccggcgcaacctgaagaattacaggtacacacactcgtgccggtaaatcttcatacaatcgttattcactttaccaaaatgcccggatgaaacccaaccacggatgcgtcaggtttcgagcttcttctatcagcattgtgcagtacttgcactgccttgttcattttgttagccttggccccgtg

SEQ ID NO: 3717 - DNA, 484 bp, Artificial; identical to SEQ ID NO: 3242
  TaSBEIIa-D allele with mutations introduced by TALEN pair TaSBEIIa_T03

SEQ ID NO: 3718 - DNA, 524 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctgggaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttgttagccttggccccgtgctggctctt

SEQ ID NO: 3719 - DNA, 484 bp, Artificial; identical to SEQ ID NO: 3242
  TaSBEIIa-D allele with mutations introduced by TALEN pair TaSBEIIa_T03

SEQ ID NO: 3720 - DNA, 467 bp, Artificial; identical to SEQ ID NO: 3534
  TaSBEIIa-D allele with mutations introduced by TALEN pair TaSBEIIa_T03

SEQ ID NO: 3721 - DNA, 520 bp, Artificial
  TaSBEIIa-D allele with mutations introduced by TALEN pair TaSBEIIa_T03
  misc_feature (411): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaaggtcctggtgcctgacggcgagagcgacgacttggcaagtccggcgcaacctgaagaattacaggtacacacactcgtgccggtaaatcttcatacaatcgttattcacttnccaaatgccggatgaaccaaccacggtgcgtcaggtttcgacttcttcatcagcatttgtgcagtactgcactgccttgtcattttgtagccttggcccgtgctggctc

SEQ ID NO: 3722 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaatcttcatacaatcgttattcacttaccaaatgccggatgaaaccaaccacggatgcgtcaggtttcgagcttcttctattcagcattgtgcagtactgcactgccttgttcattttgttagccttggccccgtgctggctcttgggccactgaa

SEQ ID NO: 3723 - DNA, 482 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3724 - DNA, 479 bp, Artificial; identical to SEQ ID NO: 3326
  TaSBEIIa-D allele with mutations introduced by TALEN pair TaSBEIIa_T03

SEQ ID NO: 3725 - DNA, 477 bp, Artificial; identical to SEQ ID NO: 3435
  TaSBEIIa-D allele with mutations introduced by TALEN pair TaSBEIIa_T03

SEQ ID NO: 3726 - DNA, 481 bp, Artificial; identical to SEQ ID NO: 3387
  TaSBEIIa-D allele with mutations introduced by TALEN pair TaSBEIIa_T03

SEQ ID NO: 3727 - DNA, 447 bp, Artificial
  TaSBEIIa-D allele with mutations introduced by TALEN pair TaSBEIIa_T03
  misc_feature (444): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactgccttgttcattttgttagcttggccccgngct

SEQ ID NO: 3728 - DNA, 543 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatacgtttggaactgacagaaccgcaacgttgaaggagccactcagccgcgggtttctggagttaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcatttgttagccttggccccgtgctggctcttgggccactg

SEQ ID NO: 3729 - DNA, 479 bp, Artificial; identical to SEQ ID NO: 3437
  TaSBEIIa-D allele with mutations introduced by TALEN pair TaSBEIIa_T03

SEQ ID NO: 3730 - DNA, 479 bp, Artificial; identical to SEQ ID NO: 3326
  TaSBEIIa-D allele with mutations introduced by TALEN pair TaSBEIIa_T03

SEQ ID NO: 3731 - DNA, 469 bp, Artificial; identical to SEQ ID NO: 3378
  TaSBEIIa-D allele with mutations introduced by TALEN pair TaSBEIIa_T03

SEQ ID NO: 3732 - DNA, 461 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctctgtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgct

SEQ ID NO: 3733 - DNA, 400 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaaggtcctggtgcctgacggcgagagcgacgacttggcaagtccggcgcaacctgaagaattacaggtacacacactcgtgccggtaaatcttcatacaatcg

SEQ ID NO: 3734 - DNA, 479 bp, Artificial; identical to SEQ ID NO: 3428
  TaSBEIIa-D allele with mutations introduced by TALEN pair TaSBEIIa_T03

SEQ ID NO: 3735 - DNA, 510 bp, Artificial
  TaSBEIIa-D allele with mutations introduced by TALEN pair TaSBEIIa_T03
  misc_feature (427): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattatcgcgcagaaaaaacaggaaggcaaaatgccgcaaaaaggggaaggtcctgtgcctgacggcgagagcgacgacttggcaagtccggcgcaacctgaagaattacaggtacacacactcgtgccggtaaatcttcatacaatcgttattcacttnccaaatgccgggatgaaaccaaccacggatgcgtcaggtttcgagcttcttctatcagcattgtgcagtactgcactgccttg

SEQ ID NO: 3736 - DNA, 440 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcacctgaagaattacaggtacacacactcgtgccggtaaatcttctacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 3737 - DNA, 483 bp, Artificial; identical to SEQ ID NO: 3279
  TaSBEIIa-D allele with mutations introduced by TALEN pair TaSBEIIa_T03

SEQ ID NO: 3738 - DNA, 454 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagcattgtgcagtactgcactgccttgttcattttgttagccttggccccgtgctggc

SEQ ID NO: 3739 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3740 - DNA, 495 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctggggaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 3741 - DNA, 456 bp, Artificial
  TaSBEIIa-D allele with mutations introduced by TALEN pair TaSBEIIa_T03
gagatagctggattaggcgatcgcgcttcctgaacctgtattttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcattgccttgttcattttgttagccttggccccgtgctggc

SEQ ID NO: 3742 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccacctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3743 - DNA, 483 bp, Artificial
  TaSBEIIa-D allele with mutations introduced by TALEN pair TaSBEIIa_T03
gagatagctggattaggcgatcgcgcttcctgaacctgtattttttccccgctgggaacgtggcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3744 - DNA, 484 bp, Artificial; identical to SEQ ID NO: 3400
  TaSBEIIa-D allele with mutations introduced by TALEN pair TaSBEIIa_T03

SEQ ID NO: 3745 - DNA, 482 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3746 - DNA, 483 bp, Artificial; identical to SEQ ID NO: 3279
  TaSBEIIa-D allele with mutations introduced by TALEN pair TaSBEIIa_T03

SEQ ID NO: 3747 - DNA, 617 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagcgcctgcttgccgccatcgtggctggcgatggccaccacctgctccgggtcaagccgtgggcctggcacagcaccggcaacagccgctgggatcttcacctagatccttttaaattaaaaatgaagttttaaatcaatctaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctctt

SEQ ID NO: 3748 - DNA, 463 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggttttcgagcttcttctatcagcattgtgcagtactgcactgccttgttcattttgttagccttggccccgtgctggtcttgggccact

SEQ ID NO: 3749 - DNA, 484 bp, Artificial; identical to SEQ ID NO: 3239
  TaSBEIIa-D allele with mutations introduced by TALEN pair TaSBEIIa_T03

SEQ ID NO: 3750 - DNA, 479 bp, Artificial; identical to SEQ ID NO: 3326
  TaSBEIIa-D allele with mutations introduced by TALEN pair TaSBEIIa_T03

SEQ ID NO: 3751 - DNA, 449 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagcattgtgcagtactgcactgccttgttcattttgttagccttggccccgtgc

SEQ ID NO: 3752 - DNA, 469 bp, Artificial; identical to SEQ ID NO: 3440
  TaSBEIIa-D allele with mutations introduced by TALEN pair TaSBEIIa_T03

SEQ ID NO: 3753 - DNA, 484 bp, Artificial; identical to SEQ ID NO: 3239
  TaSBEIIa-D allele with mutations introduced by TALEN pair TaSBEIIa_T03

SEQ ID NO: 3754 - DNA, 454 bp, Artificial
  TaSBEIIa-D allele with mutations introduced by TALEN pair TaSBEIIa_T03
gagatagctggattaggcgatcgcgcttcctgaacctgtattttttcccgctggacgatgctgttaggtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccc

SEQ ID NO: 3755 - DNA, 484 bp, Artificial; identical to SEQ ID NO: 3242
  TaSBEIIa-D allele with mutations introduced by TALEN pair TaSBEIIa_T03

SEQ ID NO: 3756 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaatgttgtggcgttttttcactattgtagtcatccttgcattttgcaggcgccgtcctgagccgcgcggcctctccaggtcctggtgcctgacggcgagagcgacgacttggccaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3757 - DNA, 487 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctgggtgcctgacggcgagagcgaccgactttgggccaagttccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3758 - DNA, 483 bp, Artificial; identical to SEQ ID NO: 3279
  TaSBEIIa-D allele with mutations introduced by TALEN pair TaSBEIIa_T03

SEQ ID NO: 3759 - DNA, 480 bp, Artificial; identical to SEQ ID NO: 3284
  TaSBEIIa-D allele with mutations introduced by TALEN pair TaSBEIIa_T03

SEQ ID NO: 3760 - DNA, 482 bp, Artificial; identical to SEQ ID NO: 3602
  TaSBEIIa-D allele with mutations introduced by TALEN pair TaSBEIIa_T03

SEQ ID NO: 3761 - DNA, 451 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 3762 - DNA, 482 bp, Artificial; identical to SEQ ID NO: 3313
  TaSBEIIa-D allele with mutations introduced by TALEN pair TaSBEIIa_T03

SEQ ID NO: 3763 - DNA, 470 bp, Artificial; identical to SEQ ID NO: 3320
  TaSBEIIa-D allele with mutations introduced by TALEN pair TaSBEIIa_T03

SEQ ID NO: 3764 - DNA, 480 bp, Artificial; identical to SEQ ID NO: 3348
  TaSBEIIa-D allele with mutations introduced by TALEN pair TaSBEIIa_T03

SEQ ID NO: 3765 - DNA, 483 bp, Artificial; identical to SEQ ID NO: 3279
  TaSBEIIa-D allele with mutations introduced by TALEN pair TaSBEIIa_T03

SEQ ID NO: 3766 - DNA, 485 bp, Artificial; identical to SEQ ID NO: 3379
  TaSBEIIa-D allele with mutations introduced by TALEN pair TaSBEIIa_T03

SEQ ID NO: 3767 - DNA, 482 bp, Artificial; identical to SEQ ID NO: 3313
  TaSBEIIa-D allele with mutations introduced by TALEN pair TaSBEIIa_T03

SEQ ID NO: 3768 - DNA, 484 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3769 - DNA, 477 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtctggtcgctgacggcgagagcgacgacttgcagtccgcgcacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3770 - DNA, 467 bp, Artificial; identical to SEQ ID NO: 3372
  TaSBEIIa-D allele with mutations introduced by TALEN pair TaSBEIIa_T03

SEQ ID NO: 3771 - DNA, 483 bp, Artificial; identical to SEQ ID NO: 3279
  TaSBEIIa-D allele with mutations introduced by TALEN pair TaSBEIIa_T03

SEQ ID NO: 3772 - DNA, 480 bp, Artificial; identical to SEQ ID NO: 3284
  TaSBEIIa-D allele with mutations introduced by TALEN pair TaSBEIIa_T03

SEQ ID NO: 3773 - DNA, 479 bp, Artificial; identical to SEQ ID NO: 3308
  TaSBEIIa-D allele with mutations introduced by TALEN pair TaSBEIIa_T03

SEQ ID NO: 3774 - DNA, 454 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagcattgtgcagtactgcactgccttgttcattttgttagccttggccccgtgctggc

SEQ ID NO: 3775 - DNA, 468 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3776 - DNA, 481 bp, Artificial; identical to SEQ ID NO: 3643
  TaSBEIIa-D allele with mutations introduced by TALEN pair TaSBEIIa_T03

SEQ ID NO: 3777 - DNA, 464 bp, Artificial
  TaSBEIIa-D allele with mutations introduced by TALEN pair TaSBEIIa_T03
  misc_feature (448): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggattgcgtcaggtttcgagcttcttctacagcattgtgcagtactgcactgcccttgttcatttttgttagccttggccccgngctggtcttgggccac

SEQ ID NO: 3778 - DNA, 454 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtg

SEQ ID NO: 3779 - DNA, 479 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3780 - DNA, 469 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgctcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 3781 - DNA, 615 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagccccgacacccgccaacacccgctgaaggtcctggtgcctgacggcgagagcgacgacttgggcaagtccggcgcaacctgaagaattacaggtacacacactcgtgccgggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3782 - DNA, 484 bp, Artificial; identical to SEQ ID NO: 3242
  TaSBEIIa-D allele with mutations introduced by TALEN pair TaSBEIIa_T03

SEQ ID NO: 3783 - DNA, 445 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccg

SEQ ID NO: 3784 - DNA, 438 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3785 - DNA, 482 bp, Artificial; identical to SEQ ID NO: 3313
  TaSBEIIa-D allele with mutations introduced by TALEN pair TaSBEIIa_T03

SEQ ID NO: 3786 - DNA, 469 bp, Artificial; identical to SEQ ID NO: 3440
  TaSBEIIa-D allele with mutations introduced by TALEN pair TaSBEIIa_T03

SEQ ID NO: 3787 - DNA, 469 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 3788 - DNA, 477 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctctctcctggtgcctgacggcgagagcgacgcttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3789 - DNA, 484 bp, Artificial; identical to SEQ ID NO: 3242
  TaSBEIIa-D allele with mutations introduced by TALEN pair TaSBEIIa_T03

SEQ ID NO: 3790 - DNA, 482 bp, Artificial; identical to SEQ ID NO: 3602
  TaSBEIIa-D allele with mutations introduced by TALEN pair TaSBEIIa_T03

SEQ ID NO: 3791 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3792 - DNA, 523 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgactggtgagtactcaaccaagtcattctgagaatagtcagcatgttcactacggaacaagtcggaataaagctaagaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 3793 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 3794 - DNA, 481 bp, Artificial; identical to SEQ ID NO: 3643
  TaSBEIIa-D allele with mutations introduced by TALEN pair TaSBEIIa_T03

SEQ ID NO: 3795 - DNA, 485 bp, Artificial; identical to SEQ ID NO: 3515
  TaSBEIIa-D allele with mutations introduced by TALEN pair TaSBEIIa_T03

SEQ ID NO: 3796 - DNA, 463 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggtcttgggccact

SEQ ID NO: 3797 - DNA, 483 bp, Artificial; identical to SEQ ID NO: 3279
  TaSBEIIa-D allele with mutations introduced by TALEN pair TaSBEIIa_T03

SEQ ID NO: 3798 - DNA, 572 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaatgccgcaaaaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttc

SEQ ID NO: 3799 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3800 - DNA, 454 bp, Artificial; identical to SEQ ID NO: 3774
  TaSBEIIa-D allele with mutations introduced by TALEN pair TaSBEIIa_T03

SEQ ID NO: 3801 - DNA, 481 bp, Artificial; identical to SEQ ID NO: 3573
  TaSBEIIa-D allele with mutations introduced by TALEN pair TaSBEIIa_T03

SEQ ID NO: 3802 - DNA, 586 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgacaccggataaggcgcagcgtcgggctgaacggggttcgggcgatctcgatcacctcgatgtacaaggtcctggtgcctgacggcgagagcgacgacttggcaagtccggcgcaacctgaagaattgacaggtacacacactcgtgccggtaaatcttcatacaatcgttattcacttaccaaattgccggatgaaaccaaccacggatgcgtcaggtttcgagcttcttctatcagcattgtgcagtactgcactgccttgttcattttgttagccttggccc

SEQ ID NO: 3803 - DNA, 468 bp, Artificial; identical to SEQ ID NO: 3287
  TaSBEIIa-D allele with mutations introduced by TALEN pair TaSBEIIa_T03

SEQ ID NO: 3804 - DNA, 479 bp, Artificial; identical to SEQ ID NO: 3428
  TaSBEIIa-D allele with mutations introduced by TALEN pair TaSBEIIa_T03

SEQ ID NO: 3805 - DNA, 480 bp, Artificial; identical to SEQ ID NO: 3284
  TaSBEIIa-D allele with mutations introduced by TALEN pair TaSBEIIa_T03

SEQ ID NO: 3806 - DNA, 481 bp, Artificial; identical to SEQ ID NO: 3336
  TaSBEIIa-D allele with mutations introduced by TALEN pair TaSBEIIa_T03

SEQ ID NO: 3807 - DNA, 451 bp, Artificial
  TaSBEIIa-D allele with mutations introduced by TALEN pair TaSBEIIa_T03
gagatagctggattaggcgatcgcgcttcctgaacctgtattttttcccgcggaacgatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggccgtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccc

SEQ ID NO: 3808 - DNA, 484 bp, Artificial; identical to SEQ ID NO: 3242
  TaSBEIIa-D allele with mutations introduced by TALEN pair TaSBEIIa_T03

SEQ ID NO: 3809 - DNA, 484 bp, Artificial; identical to SEQ ID NO: 3400
  TaSBEIIa-D allele with mutations introduced by TALEN pair TaSBEIIa_T03

SEQ ID NO: 3810 - DNA, 469 bp, Artificial; identical to SEQ ID NO: 3378
  TaSBEIIa-D allele with mutations introduced by TALEN pair TaSBEIIa_T03

SEQ ID NO: 3811 - DNA, 484 bp, Artificial; identical to SEQ ID NO: 3242
  TaSBEIIa-D allele with mutations introduced by TALEN pair TaSBEIIa_T03

SEQ ID NO: 3812 - DNA, 459 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccgggatgaaaccaacccacggatgccgtcaggttttcgagcttcttctacagcaattgtgcagtactgcactgccttgttcatttttgttagccttggcccccggctggttc

SEQ ID NO: 3813 - DNA, 455 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagcattgtgcagtactgcactgccttgttcatttttgttagccttggccccgtgctggc

SEQ ID NO: 3814 - DNA, 545 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaatgccgcaaaaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagc

SEQ ID NO: 3815 - DNA, 473 bp, Artificial; identical to SEQ ID NO: 3542
  TaSBEIIa-D allele with mutations introduced by TALEN pair TaSBEIIa_T03

SEQ ID NO: 3816 - DNA, 482 bp, Artificial; identical to SEQ ID NO: 3522
  TaSBEIIa-D allele with mutations introduced by TALEN pair TaSBEIIa_T03

SEQ ID NO: 3817 - DNA, 481 bp, Artificial; identical to SEQ ID NO: 3504
  TaSBEIIa-D allele with mutations introduced by TALEN pair TaSBEIIa_T03

SEQ ID NO: 3818 - DNA, 478 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgcctgacggcgagagcgacgactttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3819 - DNA, 484 bp, Artificial; identical to SEQ ID NO: 3242
  TaSBEIIa-D allele with mutations introduced by TALEN pair TaSBEIIa_T03

SEQ ID NO: 3820 - DNA, 484 bp, Artificial; identical to SEQ ID NO: 3230
  TaSBEIIa-D allele with mutations introduced by TALEN pair TaSBEIIa_T03

SEQ ID NO: 3821 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtacaggtttcgagcttcttctatcagcattgtgcagtactgcactgccttgttcattttgttagccttggccccgtgctggctcttgggccactgaa

SEQ ID NO: 3822 - DNA, 535 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctggggaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 3823 - DNA, 474 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgtctggctcttgggccactgaa

SEQ ID NO: 3824 - DNA, 477 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccgtgctggctcttgggccactgaa

SEQ ID NO: 3825 - DNA, 460 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcactttaccaaaatgcccggatgaaaccaaccacggatgcgtcaggtttcgagcttcttctatcagcattgtgcagtactgcactgccttgttcattttgttagccttggccccgtg

SEQ ID NO: 3826 - DNA, 480 bp, Artificial; identical to SEQ ID NO: 3348
  TaSBEIIa-D allele with mutations introduced by TALEN pair TaSBEIIa_T03

SEQ ID NO: 3827 - DNA, 482 bp, Artificial; identical to SEQ ID NO: 3522
  TaSBEIIa-D allele with mutations introduced by TALEN pair TaSBEIIa_T03

SEQ ID NO: 3828 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3829 - DNA, 454 bp, Artificial
  TaSBEIIa-D allele with mutations introduced by TALEN pair TaSBEIIa_T03
gagatagctggattaggcgatcgcgcttcctgaacctgtattttttcccgcggaacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3830 - DNA, 456 bp, Artificial; identical to SEQ ID NO: 3581
  TaSBEIIa-D allele with mutations introduced by TALEN pair TaSBEIIa_T03

SEQ ID NO: 3831 - DNA, 479 bp, Artificial; identical to SEQ ID NO: 3326
  TaSBEIIa-D allele with mutations introduced by TALEN pair TaSBEIIa_T03

SEQ ID NO: 3832 - DNA, 453 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3833 - DNA, 478 bp, Artificial; identical to SEQ ID NO: 3395
  TaSBEIIa-D allele with mutations introduced by TALEN pair TaSBEIIa_T03

SEQ ID NO: 3834 - DNA, 474 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgtctggctcttgggccact

SEQ ID NO: 3835 - DNA, 479 bp, Artificial; identical to SEQ ID NO: 3371
  TaSBEIIa-D allele with mutations introduced by TALEN pair TaSBEIIa_T03

SEQ ID NO: 3836 - DNA, 479 bp, Artificial; identical to SEQ ID NO: 3428
  TaSBEIIa-D allele with mutations introduced by TALEN pair TaSBEIIa_T03

SEQ ID NO: 3837 - DNA, 393 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcacgacggccagtgaattcgagctcggtacctcgcgaatgcatctagatccatgcttccggctcgtatgttgtgtggaggtcctggtgcctgacggcgagagcgacgacttggcaagtccggcgcaacctgaagaattacaggtacacacact

SEQ ID NO: 3838 - DNA, 477 bp, Artificial
  TaSBEIIa-D allele with mutations introduced by TALEN pair TaSBEIIa_T03
gagatagctggattaggcgatcgcgcttcctgaacctgtattttttcccgctgggaactgcgttagtgtcaccccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3839 - DNA, 480 bp, Artificial; identical to SEQ ID NO: 3284
  TaSBEIIa-D allele with mutations introduced by TALEN pair TaSBEIIa_T03

SEQ ID NO: 3840 - DNA, 479 bp, Artificial; identical to SEQ ID NO: 3308
  TaSBEIIa-D allele with mutations introduced by TALEN pair TaSBEIIa_T03

SEQ ID NO: 3841 - DNA, 484 bp, Artificial; identical to SEQ ID NO: 3242
  TaSBEIIa-D allele with mutations introduced by TALEN pair TaSBEIIa_T03

SEQ ID NO: 3842 - DNA, 568 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgactggtgagtactcaaccaagtcattctgagaatagtcagcatgttcactacggaacaagtcggaataaaagctaagaaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 3843 - DNA, 405 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcacctgaagaattacaggtacacacactcgtgccggtaaatcttctacaatcgttattcacttaccaaatgccggatgaaaccaaccacggatgcgtcaggtttcgagcttcttctatcagcattgtgcagtactgcactgccttg

SEQ ID NO: 3844 - DNA, 467 bp, Artificial; identical to SEQ ID NO: 3372
  TaSBEIIa-D allele with mutations introduced by TALEN pair TaSBEIIa_T03

SEQ ID NO: 3845 - DNA, 482 bp, Artificial; identical to SEQ ID NO: 3313
  TaSBEIIa-D allele with mutations introduced by TALEN pair TaSBEIIa_T03

SEQ ID NO: 3846 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaagatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctcccctggtgcctgacggcgagagcgacgactttggcaagtccggcgcaacctgaagaattacaggtacacacactcgtgccggtaaatcttcatacaatcgttattcacttaccaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 3847 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttccagtgctggcgcgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3848 - DNA, 467 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgcctgatgaaaccaaccacggatgcgtcaggtttcgagcttcttctatcagcattgtgcagtactgcactgccttgttcatttttgttagccttggccccgtgctggctcttgggccactgaa

SEQ ID NO: 3849 - DNA, 617 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagccccgacaaccgccaacacccgctgaaggtcctggtgcctgacggcgagagcgacgactttgggcaaagtccggcgcaacctgaagaattacaggtacacacactcgtgccgggtaaatccttcatacaatcgttattcacttaccaaatgccggatgaaaccaaccacggatgcgtcaggtttcgagcttcttctatcagcattgtgcagtactgcactgccttgttcattttgttagccttggcccgtgctggctcttgggccactgaa

SEQ ID NO: 3850 - DNA, 415 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactg

SEQ ID NO: 3851 - DNA, 545 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaggccagcaaaaaggcccaggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 3852 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3853 - DNA, 484 bp, Artificial; identical to SEQ ID NO: 3242
  TaSBEIIa-D allele with mutations introduced by TALEN pair TaSBEIIa_T03

SEQ ID NO: 3854 - DNA, 440 bp, Artificial; identical to SEQ ID NO: 3509
  TaSBEIIa-D allele with mutations introduced by TALEN pair TaSBEIIa_T03

SEQ ID NO: 3855 - DNA, 478 bp, Artificial; identical to SEQ ID NO: 3395
  TaSBEIIa-D allele with mutations introduced by TALEN pair TaSBEIIa_T03

SEQ ID NO: 3856 - DNA, 440 bp, Artificial
  TaSBEIIa-D allele with mutations introduced by TALEN pair TaSBEIIa_T03
  misc_feature (402): n is a or c or t or g
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcagtttcgagcttcttctatcagcattgngcagtactgcactgccttgttcattttgttagccttgg

SEQ ID NO: 3857 - DNA, 441 bp, Artificial
  TaSBEIIa-D allele with mutations introduced by TALEN pair TaSBEIIa_T03
  misc_feature (403): n is a or c or t or g
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagcattgngcagtactgcactgccttgttcattttgttagccttgg

SEQ ID NO: 3858 - DNA, 468 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3859 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccaaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3860 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3861 - DNA, 471 bp, Artificial
  TaSBEIIa-D allele with mutations introduced by TALEN pair TaSBEIIa_T03
gagatagctggattaggcgatcgcgcttcctgaacctgtattttttccccgcgggaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 3862 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtacttgcatctgcctgtttcattttgtcagcttggccccgtgctggctcttgggccactgaa

SEQ ID NO: 3863 - DNA, 433 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaatgccgcaaaaagcaaggtcctggtgcctgacggcgagagcgacgacttggcaagtccggcgcaacctgaagaa

SEQ ID NO: 3864 - DNA, 484 bp, Artificial; identical to SEQ ID NO: 3400
  TaSBEIIa-D allele with mutations introduced by TALEN pair TaSBEIIa_T03

SEQ ID NO: 3865 - DNA, 483 bp, Artificial; identical to SEQ ID NO: 3221
  TaSBEIIa-D allele with mutations introduced by TALEN pair TaSBEIIa_T03

SEQ ID NO: 3866 - DNA, 479 bp, Artificial; identical to SEQ ID NO: 3326
  TaSBEIIa-D allele with mutations introduced by TALEN pair TaSBEIIa_T03

SEQ ID NO: 3867 - DNA, 441 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 3868 - DNA, 456 bp, Artificial; identical to SEQ ID NO: 3581
  TaSBEIIa-D allele with mutations introduced by TALEN pair TaSBEIIa_T03

SEQ ID NO: 3869 - DNA, 510 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagccagcagcaacaggagaagatcaaaccgaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggcca

SEQ ID NO: 3870 - DNA, 429 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccttctccagtgactggtgagtactcaaccaagtcattctgagaatagtcagcatgtcactacggaacaagtcggaataaagctagaaatggtcctggtgcctgacggcgagagcgacgacttggcaagtccggcgcaacctgaagaattacaggtacacacactcgtgccggtaaatcttcatacaattcgtt

SEQ ID NO: 3871 - DNA, 467 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcatgtgcagtactgcactgccttgttcatttttgttagccttggccccgtgctggctcttgggccactgaa

SEQ ID NO: 3872 - DNA, 479 bp, Artificial; identical to SEQ ID NO: 3428
  TaSBEIIa-D allele with mutations introduced by TALEN pair TaSBEIIa_T03

SEQ ID NO: 3873 - DNA, 456 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaatcttcatacaatcgttattcacttaccaaaatgccggatgaaaccaaccacggatgcgtcaggtttcgagcttcttctacagcattgtgcagtactgcactgccttgtcattttgttagcttggccccggctggtcttgggccac

SEQ ID NO: 3874 - DNA, 453 bp, Artificial; identical to SEQ ID NO: 3832
  TaSBEIIa-D allele with mutations introduced by TALEN pair TaSBEIIa_T03

SEQ ID NO: 3875 - DNA, 483 bp, Artificial; identical to SEQ ID NO: 3279
  TaSBEIIa-D allele with mutations introduced by TALEN pair TaSBEIIa_T03

SEQ ID NO: 3876 - DNA, 485 bp, Artificial; identical to SEQ ID NO: 3379
  TaSBEIIa-D allele with mutations introduced by TALEN pair TaSBEIIa_T03

SEQ ID NO: 3877 - DNA, 481 bp, Artificial; identical to SEQ ID NO: 3504
  TaSBEIIa-D allele with mutations introduced by TALEN pair TaSBEIIa_T03

SEQ ID NO: 3878 - DNA, 482 bp, Artificial; identical to SEQ ID NO: 3313
  TaSBEIIa-D allele with mutations introduced by TALEN pair TaSBEIIa_T03

SEQ ID NO: 3879 - DNA, 481 bp, Artificial; identical to SEQ ID NO: 3573
  TaSBEIIa-D allele with mutations introduced by TALEN pair TaSBEIIa_T03

SEQ ID NO: 3880 - DNA, 482 bp, Artificial; identical to SEQ ID NO: 3313
  TaSBEIIa-D allele with mutations introduced by TALEN pair TaSBEIIa_T03

SEQ ID NO: 3881 - DNA, 451 bp, Artificial; identical to SEQ ID NO: 3646
  TaSBEIIa-D allele with mutations introduced by TALEN pair TaSBEIIa_T03

SEQ ID NO: 3882 - DNA, 455 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctgg

SEQ ID NO: 3883 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3884 - DNA, 480 bp, Artificial
  TaSBEIIa-D allele with mutations introduced by TALEN pair TaSBEIIa_T03
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3885 - DNA, 469 bp, Artificial; identical to SEQ ID NO: 3787
  TaSBEIIa-D allele with mutations introduced by TALEN pair TaSBEIIa_T03

SEQ ID NO: 3886 - DNA, 459 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccacctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgt

SEQ ID NO: 3887 - DNA, 484 bp, Artificial; identical to SEQ ID NO: 3242
  TaSBEIIa-D allele with mutations introduced by TALEN pair TaSBEIIa_T03

SEQ ID NO: 3888 - DNA, 484 bp, Artificial; identical to SEQ ID NO: 3239
  TaSBEIIa-D allele with mutations introduced by TALEN pair TaSBEIIa_T03

SEQ ID NO: 3889 - DNA, 467 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 3890 - DNA, 478 bp, Artificial; identical to SEQ ID NO: 3395
  TaSBEIIa-D allele with mutations introduced by TALEN pair TaSBEIIa_T03

SEQ ID NO: 3891 - DNA, 482 bp, Artificial
  TaSBEIIa-D allele with mutations introduced by TALEN pair TaSBEIIa_T03
gagatagctggattaggcgatcgcgcttcctgaacctgtattttttccccgcgggaaagtgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3892 - DNA, 480 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3893 - DNA, 544 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggagccgcccaggtgcttgccctgtagccgtacaccggcaacagccgctggaccgtctccagcgcctgcttgccaccattattgctgaaggtcctggtgccctgacggcgagagcgacgacttggcaagtccggcgcaacctgagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3894 - DNA, 458 bp, Artificial; identical to SEQ ID NO: 3390
  TaSBEIIa-D allele with mutations introduced by TALEN pair TaSBEIIa_T03

SEQ ID NO: 3895 - DNA, 484 bp, Artificial; identical to SEQ ID NO: 3242
  TaSBEIIa-D allele with mutations introduced by TALEN pair TaSBEIIa_T03

SEQ ID NO: 3896 - DNA, 485 bp, Artificial; identical to SEQ ID NO: 3501
  TaSBEIIa-D allele with mutations introduced by TALEN pair TaSBEIIa_T03

SEQ ID NO: 3897 - DNA, 483 bp, Artificial; identical to SEQ ID NO: 3279
  TaSBEIIa-D allele with mutations introduced by TALEN pair TaSBEIIa_T03

SEQ ID NO: 3898 - DNA, 479 bp, Artificial; identical to SEQ ID NO: 3527
  TaSBEIIa-D allele with mutations introduced by TALEN pair TaSBEIIa_T03

SEQ ID NO: 3899 - DNA, 503 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaggccagcaaaaaggccggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 3900 - DNA, 478 bp, Artificial; identical to SEQ ID NO: 3395
  TaSBEIIa-D allele with mutations introduced by TALEN pair TaSBEIIa_T03

SEQ ID NO: 3901 - DNA, 479 bp, Artificial; identical to SEQ ID NO: 3308
  TaSBEIIa-D allele with mutations introduced by TALEN pair TaSBEIIa_T03

SEQ ID NO: 3902 - DNA, 464 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 3903 - DNA, 481 bp, Artificial; identical to SEQ ID NO: 3573
  TaSBEIIa-D allele with mutations introduced by TALEN pair TaSBEIIa_T03

SEQ ID NO: 3904 - DNA, 483 bp, Artificial; identical to SEQ ID NO: 3221
  TaSBEIIa-D allele with mutations introduced by TALEN pair TaSBEIIa_T03

SEQ ID NO: 3905 - DNA, 478 bp, Artificial; identical to SEQ ID NO: 3395
  TaSBEIIa-D allele with mutations introduced by TALEN pair TaSBEIIa_T03

SEQ ID NO: 3906 - DNA, 446 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgactttgggcaaagtccggcgcaaaccctgaagaattacaggtacacacactcgtgccggtaaatctttatacaatcgttattcacttaccaaatgccggatgaaaccaaccacggatgcgtcaggtttcgagcttctctatcagcattgtgcagtactgcactgccttgttca

SEQ ID NO: 3907 - DNA, 484 bp, Artificial; identical to SEQ ID NO: 3242
  TaSBEIIa-D allele with mutations introduced by TALEN pair TaSBEIIa_T03

SEQ ID NO: 3908 - DNA, 485 bp, Artificial; identical to SEQ ID NO: 3515
  TaSBEIIa-D allele with mutations introduced by TALEN pair TaSBEIIa_T03

SEQ ID NO: 3909 - DNA, 485 bp, Artificial; identical to SEQ ID NO: 3515
  TaSBEIIa-D allele with mutations introduced by TALEN pair TaSBEIIa_T03

SEQ ID NO: 3910 - DNA, 452 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgacaccggataaggcgcagcggtcgggctgaacgggggtttcgggcatctcgatcagctcgatgtacaaggtcctggtgcctgacggcgagagcgacgacttggcaagtccggcgcaacctgaagaattacaggtacacacactcgtgcc

SEQ ID NO: 3911 - DNA, 436 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgcctgacggcgagagcgacgactttggcaagtccggcgcaacctgaagaattacaggtacacacactcgtgccggtaaatcttcatacaatcgttattcactttaccaaaatgccggatgaaaccaaccacggatgcgtcaggtttcgagcttcttctatcagcattgtgcagtactgcactgccttgttca

SEQ ID NO: 3912 - DNA, 483 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3913 - DNA, 481 bp, Artificial; identical to SEQ ID NO: 3286
  TaSBEIIa-D allele with mutations introduced by TALEN pair TaSBEIIa_T03

SEQ ID NO: 3914 - DNA, 484 bp, Artificial; identical to SEQ ID NO: 3239
  TaSBEIIa-D allele with mutations introduced by TALEN pair TaSBEIIa_T03

SEQ ID NO: 3915 - DNA, 479 bp, Artificial; identical to SEQ ID NO: 3308
  TaSBEIIa-D allele with mutations introduced by TALEN pair TaSBEIIa_T03

SEQ ID NO: 3916 - DNA, 484 bp, Artificial; identical to SEQ ID NO: 3242
  TaSBEIIa-D allele with mutations introduced by TALEN pair TaSBEIIa_T03

SEQ ID NO: 3917 - DNA, 493 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgttattcacttaccaaatgccgggatgaaaccaaccacggatgcgtcaggtttcgagctcttctatcagcattgtgcagtactgcactgccttg

SEQ ID NO: 3918 - DNA, 482 bp, Artificial; identical to SEQ ID NO: 3313
  TaSBEIIa-D allele with mutations introduced by TALEN pair TaSBEIIa_T03

SEQ ID NO: 3919 - DNA, 510 bp, Artificial
  TaSBEIIa-D allele with mutations introduced by TALEN pair TaSBEIIa_T03
gagatagctggattaggcgatcgcgcttcctgaacctgtattttttccccgcggggaaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagccagcagcaacaggagaagatcaaaccgaaggtcctggtgcctgacggcgagagcgacgacttggcaagtccggcgcacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggcca

SEQ ID NO: 3920 - DNA, 484 bp, Artificial; identical to SEQ ID NO: 3242
  TaSBEIIa-D allele with mutations introduced by TALEN pair TaSBEIIa_T03

SEQ ID NO: 3921 - DNA, 470 bp, Artificial; identical to SEQ ID NO: 3580
  TaSBEIIa-D allele with mutations introduced by TALEN pair TaSBEIIa_T03

SEQ ID NO: 3922 - DNA, 490 bp, Artificial
  TaSBEIIa-D allele with mutations introduced by TALEN pair TaSBEIIa_T03
  misc_feature (358): n is a or c or t or g
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcagtactggtctcggtacctggacggcagagcgacgacgtgtaggtccagccgcaccacttgaagaatttacaggtacacacactcgtgccggtaaatcttcatacaatcgttattcncttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3923 - DNA, 480 bp, Artificial; identical to SEQ ID NO: 3276
  TaSBEIIa-D allele with mutations introduced by TALEN pair TaSBEIIa_T03

SEQ ID NO: 3924 - DNA, 481 bp, Artificial; identical to SEQ ID NO: 3504
  TaSBEIIa-D allele with mutations introduced by TALEN pair TaSBEIIa_T03

SEQ ID NO: 3925 - DNA, 479 bp, Artificial; identical to SEQ ID NO: 3308
  TaSBEIIa-D allele with mutations introduced by TALEN pair TaSBEIIa_T03

SEQ ID NO: 3926 - DNA, 450 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaaatgccggatgaaaccaaccacggattgcgtcaggtttcgagcttcttctacagcattgtgcagtactgcactgccttgttcattttgttagctggccccggctgtcttgggccact

SEQ ID NO: 3927 - DNA, 471 bp, Artificial
  TaSBEIIa-D allele with mutations introduced by TALEN pair TaSBEIIa_T03
gagatagctggattaggcgatcgcgcttcctgaacctgtattttttcccgcgggaacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgctgctggctcttgggccactgaa

SEQ ID NO: 3928 - DNA, 471 bp, Artificial
  TaSBEIIa-D allele with mutations introduced by TALEN pair TaSBEIIa_T03
  misc_feature (426): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattacgcgcagaaaaacaggaaggcaaaatgccgcaaaaaggggaaggtcctggtgcctgacggcgagagcgacgacttggcaagtccggcgcaacctgaagaattacaggtacacacactcgtgccggtaaatcttcatacaatcgttattcacttnccaaatgccggatgaaaccaaccacggatgcgtcaggtttcgagc

SEQ ID NO: 3929 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3930 - DNA, 450 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 3931 - DNA, 455 bp, Artificial; identical to SEQ ID NO: 3514
  TaSBEIIa-D allele with mutations introduced by TALEN pair TaSBEIIa_T03

SEQ ID NO: 3932 - DNA, 482 bp, Artificial; identical to SEQ ID NO: 3602
  TaSBEIIa-D allele with mutations introduced by TALEN pair TaSBEIIa_T03

SEQ ID NO: 3933 - DNA, 479 bp, Artificial; identical to SEQ ID NO: 3470
  TaSBEIIa-D allele with mutations introduced by TALEN pair TaSBEIIa_T03

SEQ ID NO: 3934 - DNA, 481 bp, Artificial; identical to SEQ ID NO: 3286
  TaSBEIIa-D allele with mutations introduced by TALEN pair TaSBEIIa_T03

SEQ ID NO: 3935 - DNA, 611 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgacaccggataaggcgcagcggtcgggctgaacgggggttcgggcgatctcgatcagctcgatgtacaaggtcctggtgcctgacggcgagagcgacgacttggcaagtccggcgcaacctgaagaattgacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccgtgctggctcttgggccactgaa

SEQ ID NO: 3936 - DNA, 480 bp, Artificial; identical to SEQ ID NO: 3348
  TaSBEIIa-D allele with mutations introduced by TALEN pair TaSBEIIa_T03

SEQ ID NO: 3937 - DNA, 406 bp, Artificial
  TaSBEIIa-D allele with mutations introduced by TALEN pair TaSBEIIa_T03
  misc_feature (295): n is a or c or t or g
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtncacacactcgtgccggtaaatcttcatacatcgttattcacttaccaaatgccggatgaaaccaaccacggatgcgtcagtttcgagcttcttctatcagcatgtgcagta

SEQ ID NO: 3938 - DNA, 484 bp, Artificial; identical to SEQ ID NO: 3242
  TaSBEIIa-D allele with mutations introduced by TALEN pair TaSBEIIa_T03

SEQ ID NO: 3939 - DNA, 484 bp, Artificial; identical to SEQ ID NO: 3242
  TaSBEIIa-D allele with mutations introduced by TALEN pair TaSBEIIa_T03

SEQ ID NO: 3940 - DNA, 484 bp, Artificial; identical to SEQ ID NO: 3242
  TaSBEIIa-D allele with mutations introduced by TALEN pair TaSBEIIa_T03

SEQ ID NO: 3941 - DNA, 481 bp, Artificial; identical to SEQ ID NO: 3860
  TaSBEIIa-D allele with mutations introduced by TALEN pair TaSBEIIa_T03

SEQ ID NO: 3942 - DNA, 479 bp, Artificial; identical to SEQ ID NO: 3308
  TaSBEIIa-D allele with mutations introduced by TALEN pair TaSBEIIa_T03

SEQ ID NO: 3943 - DNA, 451 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgt

SEQ ID NO: 3944 - DNA, 483 bp, Artificial; identical to SEQ ID NO: 3279
  TaSBEIIa-D allele with mutations introduced by TALEN pair TaSBEIIa_T03

SEQ ID NO: 3945 - DNA, 482 bp, Artificial; identical to SEQ ID NO: 3602
  TaSBEIIa-D allele with mutations introduced by TALEN pair TaSBEIIa_T03

SEQ ID NO: 3946 - DNA, 483 bp, Artificial; identical to SEQ ID NO: 3279
  TaSBEIIa-D allele with mutations introduced by TALEN pair TaSBEIIa_T03

SEQ ID NO: 3947 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgtctgacggcgagagcgacgacttggcaagtccgcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactaa

SEQ ID NO: 3948 - DNA, 483 bp, Artificial; identical to SEQ ID NO: 3279
  TaSBEIIa-D allele with mutations introduced by TALEN pair TaSBEIIa_T03

SEQ ID NO: 3949 - DNA, 484 bp, Artificial; identical to SEQ ID NO: 3242
  TaSBEIIa-D allele with mutations introduced by TALEN pair TaSBEIIa_T03

SEQ ID NO: 3950 - DNA, 444 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3951 - DNA, 411 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttg

SEQ ID NO: 3952 - DNA, 451 bp, Artificial; identical to SEQ ID NO: 3761
  TaSBEIIa-D allele with mutations introduced by TALEN pair TaSBEIIa_T03

SEQ ID NO: 3953 - DNA, 482 bp, Artificial; identical to SEQ ID NO: 3522
  TaSBEIIa-D allele with mutations introduced by TALEN pair TaSBEIIa_T03

SEQ ID NO: 3954 - DNA, 484 bp, Artificial; identical to SEQ ID NO: 3242
  TaSBEIIa-D allele with mutations introduced by TALEN pair TaSBEIIa_T03

SEQ ID NO: 3955 - DNA, 482 bp, Artificial; identical to SEQ ID NO: 3313
  TaSBEIIa-D allele with mutations introduced by TALEN pair TaSBEIIa_T03

SEQ ID NO: 3956 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgactttggcaagttccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3957 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgaaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3958 - DNA, 483 bp, Artificial; identical to SEQ ID NO: 3279
  TaSBEIIa-D allele with mutations introduced by TALEN pair TaSBEIIa_T03

SEQ ID NO: 3959 - DNA, 464 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagcattgtgcagtactgcactgccttgttcattttgttagccttggccccgtgctggctcttgggcca

SEQ ID NO: 3960 - DNA, 521 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgactggtgagtactcaaccaagtcattctgagaatagtcagcatgttcactacggaacaagtcggaataaagctaagaaaggtcctggtgcctgacggcgagagcgacgacttggcaagtccggcgcaacctgaagaattacaggtacacacactcgtgccggtaaatcttcatacaatcgttattcacttaccaaatgccggtgaaacaaccacggatgcgtcaggtttcgagcttcttctatcagcattgtgcagtactgcactgccttgttca

SEQ ID NO: 3961 - DNA, 484 bp, Artificial; identical to SEQ ID NO: 3242
  TaSBEIIa-D allele with mutations introduced by TALEN pair TaSBEIIa_T03

SEQ ID NO: 3962 - DNA, 481 bp, Artificial
  TaSBEIIa-D allele with mutations introduced by TALEN pair TaSBEIIa_T03
gagatagctggattaggcgatcgcgcttcctgaacctgtattttttcccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3963 - DNA, 476 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3964 - DNA, 485 bp, Artificial; identical to SEQ ID NO: 3501
  TaSBEIIa-D allele with mutations introduced by TALEN pair TaSBEIIa_T03

SEQ ID NO: 3965 - DNA, 509 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctgggaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 3966 - DNA, 481 bp, Artificial; identical to SEQ ID NO: 3286
  TaSBEIIa-D allele with mutations introduced by TALEN pair TaSBEIIa_T03

SEQ ID NO: 3967 - DNA, 479 bp, Artificial; identical to SEQ ID NO: 3371
  TaSBEIIa-D allele with mutations introduced by TALEN pair TaSBEIIa_T03

SEQ ID NO: 3968 - DNA, 466 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccagtgctggctcttgggccactg

SEQ ID NO: 3969 - DNA, 481 bp, Artificial; identical to SEQ ID NO: 3573
  TaSBEIIa-D allele with mutations introduced by TALEN pair TaSBEIIa_T03

SEQ ID NO: 3970 - DNA, 459 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3971 - DNA, 485 bp, Artificial; identical to SEQ ID NO: 3515
  TaSBEIIa-D allele with mutations introduced by TALEN pair TaSBEIIa_T03

SEQ ID NO: 3972 - DNA, 454 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 3973 - DNA, 450 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 3974 - DNA, 455 bp, Artificial; identical to SEQ ID NO: 3514
  TaSBEIIa-D allele with mutations introduced by TALEN pair TaSBEIIa_T03

SEQ ID NO: 3975 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttatccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3976 - DNA, 485 bp, Artificial; identical to SEQ ID NO: 3316
  TaSBEIIa-D allele with mutations introduced by TALEN pair TaSBEIIa_T03

SEQ ID NO: 3977 - DNA, 471 bp, Artificial
  TaSBEIIa-D allele with mutations introduced by TALEN pair TaSBEIIa_T03
gagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagcggcgagagcgacgacttggcaagtccggcgcaacctgaagaacttacaggtatcacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 3978 - DNA, 461 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctacagcattgtgcagtactgcactgccttgttcattttgttagccttggcccccgtgctggtcttgggccac

SEQ ID NO: 3979 - DNA, 481 bp, Artificial; identical to SEQ ID NO: 3336
  TaSBEIIa-D allele with mutations introduced by TALEN pair TaSBEIIa_T03

SEQ ID NO: 3980 - DNA, 481 bp, Artificial; identical to SEQ ID NO: 3573
  TaSBEIIa-D allele with mutations introduced by TALEN pair TaSBEIIa_T03

SEQ ID NO: 3981 - DNA, 484 bp, Artificial; identical to SEQ ID NO: 3242
  TaSBEIIa-D allele with mutations introduced by TALEN pair TaSBEIIa_T03

SEQ ID NO: 3982 - DNA, 476 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcacctgaagaattacaggtacacacactcgtgccggtaaatcttcatacaatcgttattcacttaccaaatgccggatgaaacaaccacggatgcgtcaggtttcgagcttcttctatcagcattgtgcagtactgcactgccttgttcatttttgttagccttggccccgtgctggctcttgggcca

SEQ ID NO: 3983 - DNA, 469 bp, Artificial
  TaSBEIIa-D allele with mutations introduced by TALEN pair TaSBEIIa_T03
gagatagctggattaggcgatcgcgcttcctgaacctgtattttttcccgcgggaacgatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3984 - DNA, 479 bp, Artificial; identical to SEQ ID NO: 3326
  TaSBEIIa-D allele with mutations introduced by TALEN pair TaSBEIIa_T03

SEQ ID NO: 3985 - DNA, 403 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgtta

SEQ ID NO: 3986 - DNA, 513 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgacaccggataaggcgcagcggtcgggctgaacgggggttcgggcatctcgatcagctcgatgtacaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgc

SEQ ID NO: 3987 - DNA, 484 bp, Artificial; identical to SEQ ID NO: 3239
  TaSBEIIa-D allele with mutations introduced by TALEN pair TaSBEIIa_T03

SEQ ID NO: 3988 - DNA, 469 bp, Artificial; identical to SEQ ID NO: 3378
  TaSBEIIa-D allele with mutations introduced by TALEN pair TaSBEIIa_T03

SEQ ID NO: 3989 - DNA, 479 bp, Artificial; identical to SEQ ID NO: 3326
  TaSBEIIa-D allele with mutations introduced by TALEN pair TaSBEIIa_T03

SEQ ID NO: 3990 - DNA, 482 bp, Artificial; identical to SEQ ID NO: 3572
  TaSBEIIa-D allele with mutations introduced by TALEN pair TaSBEIIa_T03

SEQ ID NO: 3991 - DNA, 483 bp, Artificial; identical to SEQ ID NO: 3279
  TaSBEIIa-D allele with mutations introduced by TALEN pair TaSBEIIa_T03

SEQ ID NO: 3992 - DNA, 467 bp, Artificial; identical to SEQ ID NO: 3889
  TaSBEIIa-D allele with mutations introduced by TALEN pair TaSBEIIa_T03

SEQ ID NO: 3993 - DNA, 484 bp, Artificial; identical to SEQ ID NO: 3242
  TaSBEIIa-D allele with mutations introduced by TALEN pair TaSBEIIa_T03

SEQ ID NO: 3994 - DNA, 478 bp, Artificial; identical to SEQ ID NO: 3395
  TaSBEIIa-D allele with mutations introduced by TALEN pair TaSBEIIa_T03

SEQ ID NO: 3995 - DNA, 485 bp, Artificial; identical to SEQ ID NO: 3501
  TaSBEIIa-D allele with mutations introduced by TALEN pair TaSBEIIa_T03

SEQ ID NO: 3996 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 3997 - DNA, 485 bp, Artificial; identical to SEQ ID NO: 3501
  TaSBEIIa-D allele with mutations introduced by TALEN pair TaSBEIIa_T03

SEQ ID NO: 3998 - DNA, 469 bp, Artificial; identical to SEQ ID NO: 3440
  TaSBEIIa-D allele with mutations introduced by TALEN pair TaSBEIIa_T03

SEQ ID NO: 3999 - DNA, 461 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 4000 - DNA, 484 bp, Artificial; identical to SEQ ID NO: 3240
  TaSBEIIa-D allele with mutations introduced by TALEN pair TaSBEIIa_T03

SEQ ID NO: 4001 - DNA, 483 bp, Artificial; identical to SEQ ID NO: 3279
  TaSBEIIa-D allele with mutations introduced by TALEN pair TaSBEIIa_T03

SEQ ID NO: 4002 - DNA, 453 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactgccttgttcattttgttagccttggccccgtgctggtcttgggccact

SEQ ID NO: 4003 - DNA, 482 bp, Artificial; identical to SEQ ID NO: 3270
  TaSBEIIa-D allele with mutations introduced by TALEN pair TaSBEIIa_T03

SEQ ID NO: 4004 - DNA, 478 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4005 - DNA, 483 bp, Artificial; identical to SEQ ID NO: 3279
  TaSBEIIa-D allele with mutations introduced by TALEN pair TaSBEIIa_T03

SEQ ID NO: 4006 - DNA, 478 bp, Artificial; identical to SEQ ID NO: 3395
  TaSBEIIa-D allele with mutations introduced by TALEN pair TaSBEIIa_T03

SEQ ID NO: 4007 - DNA, 483 bp, Artificial; identical to SEQ ID NO: 3279
  TaSBEIIa-D allele with mutations introduced by TALEN pair TaSBEIIa_T03

SEQ ID NO: 4008 - DNA, 484 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4009 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcactttaccaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 4010 - DNA, 533 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaggccagcaaaaggccggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4011 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4012 - DNA, 629 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagcgcctgcttgccgccatcgtggctggcgatggccaccacctgctccgggtcaagccgtgggcctggcacagcaccggcaacagccgctgggatcttcacctagatccttttaaattaaaaatgaagttttaaatcaatctaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggattgcgtcaggttttcgagcttcttctatcagcattgtgcagtactgcactgcctttgttcatttttgttagccttggccccgtgctggctcttgggccactg

SEQ ID NO: 4013 - DNA, 484 bp, Artificial; identical to SEQ ID NO: 3242
  TaSBEIIa-D allele with mutations introduced by TALEN pair TaSBEIIa_T03

SEQ ID NO: 4014 - DNA, 469 bp, Artificial; identical to SEQ ID NO: 3440
  TaSBEIIa-D allele with mutations introduced by TALEN pair TaSBEIIa_T03

SEQ ID NO: 4015 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4016 - DNA, 484 bp, Artificial; identical to SEQ ID NO: 3242
  TaSBEIIa-D allele with mutations introduced by TALEN pair TaSBEIIa_T03

SEQ ID NO: 4017 - DNA, 505 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagccagcagcaacaggagaagatcaaaccgaaggtcctggtgcctgacggcgagagcgacgacttggcaagtccggcgcacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttggg

SEQ ID NO: 4018 - DNA, 478 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcactttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4019 - DNA, 470 bp, Artificial; identical to SEQ ID NO: 3320
  TaSBEIIa-D allele with mutations introduced by TALEN pair TaSBEIIa_T03

SEQ ID NO: 4020 - DNA, 469 bp, Artificial; identical to SEQ ID NO: 3378
  TaSBEIIa-D allele with mutations introduced by TALEN pair TaSBEIIa_T03

SEQ ID NO: 4021 - DNA, 493 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttg

SEQ ID NO: 4022 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtacggtcgctgactgcgagagcgcgactgtagtccagccgcacactgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4023 - DNA, 484 bp, Artificial; identical to SEQ ID NO: 3242
  TaSBEIIa-D allele with mutations introduced by TALEN pair TaSBEIIa_T03

SEQ ID NO: 4024 - DNA, 483 bp, Artificial; identical to SEQ ID NO: 3279
  TaSBEIIa-D allele with mutations introduced by TALEN pair TaSBEIIa_T03

SEQ ID NO: 4025 - DNA, 485 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgactttggccaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4026 - DNA, 477 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttggcaagtccggcgcaacctgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggcca

SEQ ID NO: 4027 - DNA, 467 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactg

SEQ ID NO: 4028 - DNA, 485 bp, Artificial; identical to SEQ ID NO: 3515
  TaSBEIIa-D allele with mutations introduced by TALEN pair TaSBEIIa_T03

SEQ ID NO: 4029 - DNA, 484 bp, Artificial; identical to SEQ ID NO: 3242
  TaSBEIIa-D allele with mutations introduced by TALEN pair TaSBEIIa_T03

SEQ ID NO: 4030 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 4031 - DNA, 484 bp, Artificial; identical to SEQ ID NO: 3242
  TaSBEIIa-D allele with mutations introduced by TALEN pair TaSBEIIa_T03

SEQ ID NO: 4032 - DNA, 484 bp, Artificial; identical to SEQ ID NO: 3240
  TaSBEIIa-D allele with mutations introduced by TALEN pair TaSBEIIa_T03

SEQ ID NO: 4033 - DNA, 468 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgctgctggctcttgggccactg

SEQ ID NO: 4034 - DNA, 485 bp, Artificial; identical to SEQ ID NO: 3316
  TaSBEIIa-D allele with mutations introduced by TALEN pair TaSBEIIa_T03

SEQ ID NO: 4035 - DNA, 484 bp, Artificial; identical to SEQ ID NO: 3242
  TaSBEIIa-D allele with mutations introduced by TALEN pair TaSBEIIa_T03

SEQ ID NO: 4036 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgactttggcaagtccggcgcaacctgaagaattacaggtacacacactcgtgccggtaaatcttcatacaatcgttattcactttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4037 - DNA, 484 bp, Artificial; identical to SEQ ID NO: 3242
  TaSBEIIa-D allele with mutations introduced by TALEN pair TaSBEIIa_T03

SEQ ID NO: 4038 - DNA, 432 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttca

SEQ ID NO: 4039 - DNA, 483 bp, Artificial; identical to SEQ ID NO: 3279
  TaSBEIIa-D allele with mutations introduced by TALEN pair TaSBEIIa_T03

SEQ ID NO: 4040 - DNA, 484 bp, Artificial; identical to SEQ ID NO: 3242
  TaSBEIIa-D allele with mutations introduced by TALEN pair TaSBEIIa_T03

SEQ ID NO: 4041 - DNA, 484 bp, Artificial; identical to SEQ ID NO: 3242
  TaSBEIIa-D allele with mutations introduced by TALEN pair TaSBEIIa_T03

SEQ ID NO: 4042 - DNA, 530 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggagccgcccaggtgcttgcccctgtagccgtacaccggcaacagccgctggaccgtctccagcgcctgcttgccaccattattgctgaaggtcctggtgccctgacggcgagagcgacgacttggcaagtccggcgcaacctgagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 4043 - DNA, 452 bp, Artificial
  TaSBEIIa-D allele with mutations introduced by TALEN pair TaSBEIIa_T03
  misc_feature (435): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactgccttgttcattttgttagcttggccccgngctggtcttgggccact

SEQ ID NO: 4044 - DNA, 485 bp, Artificial; identical to SEQ ID NO: 3379
  TaSBEIIa-D allele with mutations introduced by TALEN pair TaSBEIIa_T03

SEQ ID NO: 4045 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4046 - DNA, 483 bp, Artificial; identical to SEQ ID NO: 3279
  TaSBEIIa-D allele with mutations introduced by TALEN pair TaSBEIIa_T03

SEQ ID NO: 4047 - DNA, 519 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagtcgcgcggcctctccatacgtttggaactgacagaaccgcaacgttgaaggagccactcagccgcgggtttctggagttaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttgg

SEQ ID NO: 4048 - DNA, 470 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4049 - DNA, 484 bp, Artificial; identical to SEQ ID NO: 3242
  TaSBEIIa-D allele with mutations introduced by TALEN pair TaSBEIIa_T03

SEQ ID NO: 4050 - DNA, 484 bp, Artificial; identical to SEQ ID NO: 3242
  TaSBEIIa-D allele with mutations introduced by TALEN pair TaSBEIIa_T03

SEQ ID NO: 4051 - DNA, 448 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcca

SEQ ID NO: 4052 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttgcaggcgccgtcctgagccgcgcggcctctcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 4053 - DNA, 440 bp, Artificial; identical to SEQ ID NO: 3415
  TaSBEIIa-D allele with mutations introduced by TALEN pair TaSBEIIa_T03

SEQ ID NO: 4054 - DNA, 479 bp, Artificial; identical to SEQ ID NO: 3326
  TaSBEIIa-D allele with mutations introduced by TALEN pair TaSBEIIa_T03

SEQ ID NO: 4055 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatcctggtgcctgacggcgagagcgacgacttggcaagtccggcgcaacctgaagaattacaggtacacacactcgtgccggtaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4056 - DNA, 482 bp, Artificial; identical to SEQ ID NO: 3278
  TaSBEIIa-D allele with mutations introduced by TALEN pair TaSBEIIa_T03

SEQ ID NO: 4057 - DNA, 484 bp, Artificial; identical to SEQ ID NO: 3239
  TaSBEIIa-D allele with mutations introduced by TALEN pair TaSBEIIa_T03

SEQ ID NO: 4058 - DNA, 479 bp, Artificial; identical to SEQ ID NO: 3326
  TaSBEIIa-D allele with mutations introduced by TALEN pair TaSBEIIa_T03

SEQ ID NO: 4059 - DNA, 473 bp, Artificial; identical to SEQ ID NO: 3542
  TaSBEIIa-D allele with mutations introduced by TALEN pair TaSBEIIa_T03

SEQ ID NO: 4060 - DNA, 533 bp, Artificial
  TaSBEIIa-D allele with mutations introduced by TALEN pair TaSBEIIa_T03
  misc_feature (410): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgttatcacttnccaaatgccggatgaaaccaaccacggatgcgtcaggtttcgagcttcttctatcagcattgtgcagtactgcactgccttgtcattttgtagccttggcccgtgctggctcttgggccactg

SEQ ID NO: 4061 - DNA, 482 bp, Artificial; identical to SEQ ID NO: 3313
  TaSBEIIa-D allele with mutations introduced by TALEN pair TaSBEIIa_T03

SEQ ID NO: 4062 - DNA, 483 bp, Artificial; identical to SEQ ID NO: 3279
  TaSBEIIa-D allele with mutations introduced by TALEN pair TaSBEIIa_T03

SEQ ID NO: 4063 - DNA, 479 bp, Artificial; identical to SEQ ID NO: 3371
  TaSBEIIa-D allele with mutations introduced by TALEN pair TaSBEIIa_T03

SEQ ID NO: 4064 - DNA, 483 bp, Artificial; identical to SEQ ID NO: 3279
  TaSBEIIa-D allele with mutations introduced by TALEN pair TaSBEIIa_T03

SEQ ID NO: 4065 - DNA, 511 bp, Artificial
  TaSBEIIa-D allele with mutations introduced by TALEN pair TaSBEIIa_T03
  misc_feature (460): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcccggagcaggtggtggccatcgccagccacgatggcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacgggtgcgtcggttttcgagcttcttctatcagcattgngcagtactgcactgccttgttcatttttgttagccttggccccgtgctggc

SEQ ID NO: 4066 - DNA, 483 bp, Artificial; identical to SEQ ID NO: 3279
  TaSBEIIa-D allele with mutations introduced by TALEN pair TaSBEIIa_T03

SEQ ID NO: 4067 - DNA, 615 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagccccgacacccgcccaacacccgctgaaggtcctggtgcctgacggcgagagcgacgacttggcaaagtccggcgcaacctgaagaattacaggtacacacactcgtgccggtaaatcttcatacaatcgttattcacttaccaaattgccggatgaaaccaaccacggatgcgtcaggtttcgagcttcttctatcagcattgtgcagtactgcactgccttgttcattttgttagccttggcccgtgctggctcttgggccactgaa

SEQ ID NO: 4068 - DNA, 484 bp, Artificial; identical to SEQ ID NO: 3242
  TaSBEIIa-D allele with mutations introduced by TALEN pair TaSBEIIa_T03

SEQ ID NO: 4069 - DNA, 522 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgactggtgagtactcaaccaagtcattctgagaatagtcagcatgttcactacggaacaagtcggaataaagctaagaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctacagcattgtgcagtactgcactgccttgttca

SEQ ID NO: 4070 - DNA, 450 bp, Artificial
  TaSBEIIa-D allele with mutations introduced by TALEN pair TaSBEIIa_T03
gagatagctggattaggcgatcgcgcttcctgaacctgtattttttcccgcgggacgatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcctt

SEQ ID NO: 4071 - DNA, 442 bp, Artificial; identical to SEQ ID NO: 3447
  TaSBEIIa-D allele with mutations introduced by TALEN pair TaSBEIIa_T03

SEQ ID NO: 4072 - DNA, 479 bp, Artificial; identical to SEQ ID NO: 3326
  TaSBEIIa-D allele with mutations introduced by TALEN pair TaSBEIIa_T03

SEQ ID NO: 4073 - DNA, 478 bp, Artificial; identical to SEQ ID NO: 3395
  TaSBEIIa-D allele with mutations introduced by TALEN pair TaSBEIIa_T03

SEQ ID NO: 4074 - DNA, 526 bp, Artificial
  TaSBEIIa-D allele with mutations introduced by TALEN pair TaSBEIIa_T03
  misc_feature (466): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagtcacgttatgacccccgccgatgacgcgggacaagccgttttacgtttggaactgaggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagnactgcactgccttgtgcattttgttagccgtggccccgtgctggctcttgggccactgaa

SEQ ID NO: 4075 - DNA, 486 bp, Artificial; identical to SEQ ID NO: 4030
  TaSBEIIa-D allele with mutations introduced by TALEN pair TaSBEIIa_T03

SEQ ID NO: 4076 - DNA, 484 bp, Artificial; identical to SEQ ID NO: 3242
  TaSBEIIa-D allele with mutations introduced by TALEN pair TaSBEIIa_T03

SEQ ID NO: 4077 - DNA, 469 bp, Artificial; identical to SEQ ID NO: 3378
  TaSBEIIa-D allele with mutations introduced by TALEN pair TaSBEIIa_T03

SEQ ID NO: 4078 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgctaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4079 - DNA, 484 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4080 - DNA, 476 bp, Artificial; identical to SEQ ID NO: 3963
  TaSBEIIa-D allele with mutations introduced by TALEN pair TaSBEIIa_T03

SEQ ID NO: 4081 - DNA, 455 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 4082 - DNA, 484 bp, Artificial; identical to SEQ ID NO: 3242
  TaSBEIIa-D allele with mutations introduced by TALEN pair TaSBEIIa_T03

SEQ ID NO: 4083 - DNA, 484 bp, Artificial; identical to SEQ ID NO: 3242
  TaSBEIIa-D allele with mutations introduced by TALEN pair TaSBEIIa_T03

SEQ ID NO: 4084 - DNA, 479 bp, Artificial; identical to SEQ ID NO: 3371
  TaSBEIIa-D allele with mutations introduced by TALEN pair TaSBEIIa_T03

SEQ ID NO: 4085 - DNA, 479 bp, Artificial; identical to SEQ ID NO: 3428
  TaSBEIIa-D allele with mutations introduced by TALEN pair TaSBEIIa_T03

SEQ ID NO: 4086 - DNA, 415 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactg

SEQ ID NO: 4087 - DNA, 494 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcacgacggccagtgaattcgagctcggtacctcgcgaatgcatctagatccatgcttccggctcgtatgttgtgtggaggtcctggtgcctgacggcgagagcgacgacttggcaagtccggcgcaactgaagaattacggtacacacactcgtgccggtaaatcttcatacaattcggttatttcacttaccaaattgccggtgaaacaccacgatgcgtcaggtttcgagcttcttctacagcattgtgcag

SEQ ID NO: 4088 - DNA, 470 bp, Artificial; identical to SEQ ID NO: 3320
  TaSBEIIa-D allele with mutations introduced by TALEN pair TaSBEIIa_T03

SEQ ID NO: 4089 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtctggtcgctgactggcggagagcgacgacttgtcaagtccggcgcaccctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4090 - DNA, 398 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcg

SEQ ID NO: 4091 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4092 - DNA, 484 bp, Artificial; identical to SEQ ID NO: 3242
  TaSBEIIa-D allele with mutations introduced by TALEN pair TaSBEIIa_T03

SEQ ID NO: 4093 - DNA, 468 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactg

SEQ ID NO: 4094 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4095 - DNA, 484 bp, Artificial; identical to SEQ ID NO: 3242
  TaSBEIIa-D allele with mutations introduced by TALEN pair TaSBEIIa_T03

SEQ ID NO: 4096 - DNA, 518 bp, Artificial
  TaSBEIIa-D allele with mutations introduced by TALEN pair TaSBEIIa_T03
  misc_feature (466): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcccggagcaggtggtggccatcgccagccatgatggcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagnactgcactgccttgttcattttgttagccttggccccgtgctggctcttggg

SEQ ID NO: 4097 - DNA, 470 bp, Artificial; identical to SEQ ID NO: 3580
  TaSBEIIa-D allele with mutations introduced by TALEN pair TaSBEIIa_T03

SEQ ID NO: 4098 - DNA, 483 bp, Artificial; identical to SEQ ID NO: 3247
  TaSBEIIa-D allele with mutations introduced by TALEN pair TaSBEIIa_T03

SEQ ID NO: 4099 - DNA, 480 bp, Artificial; identical to SEQ ID NO: 3348
  TaSBEIIa-D allele with mutations introduced by TALEN pair TaSBEIIa_T03

SEQ ID NO: 4100 - DNA, 479 bp, Artificial; identical to SEQ ID NO: 3308
  TaSBEIIa-D allele with mutations introduced by TALEN pair TaSBEIIa_T03

SEQ ID NO: 4101 - DNA, 483 bp, Artificial; identical to SEQ ID NO: 3279
  TaSBEIIa-D allele with mutations introduced by TALEN pair TaSBEIIa_T03

SEQ ID NO: 4102 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgctccagccccaggcctggtgtaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4103 - DNA, 578 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagacggtgcaggcgctgttgccggtgctgtgccaggcccacggctttgaccccggagcaggtggtggccatcgccagccacgatggcggcaagcaaggtcctggtgcctgacggcgagagcgacgacttggcaagtccggcgcacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4104 - DNA, 481 bp, Artificial; identical to SEQ ID NO: 3336
  TaSBEIIa-D allele with mutations introduced by TALEN pair TaSBEIIa_T03

SEQ ID NO: 4105 - DNA, 483 bp, Artificial; identical to SEQ ID NO: 3279
  TaSBEIIa-D allele with mutations introduced by TALEN pair TaSBEIIa_T03

SEQ ID NO: 4106 - DNA, 451 bp, Artificial; identical to SEQ ID NO: 3761
  TaSBEIIa-D allele with mutations introduced by TALEN pair TaSBEIIa_T03

SEQ ID NO: 4107 - DNA, 425 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaaatgccggatgaaaccaaccacggattgcgtcaggtttcgagcttcttctacagcattgtgcagtactgcactgccttgttcattttgttagc

SEQ ID NO: 4108 - DNA, 430 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgca

SEQ ID NO: 4109 - DNA, 483 bp, Artificial; identical to SEQ ID NO: 3279
  TaSBEIIa-D allele with mutations introduced by TALEN pair TaSBEIIa_T03

SEQ ID NO: 4110 - DNA, 524 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctggggaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctc

SEQ ID NO: 4111 - DNA, 545 bp, Artificial; identical to SEQ ID NO: 3671
  TaSBEIIa-D allele with mutations introduced by TALEN pair TaSBEIIa_T03

SEQ ID NO: 4112 - DNA, 451 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccccgtgctgg

SEQ ID NO: 4113 - DNA, 463 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 4114 - DNA, 453 bp, Artificial; identical to SEQ ID NO: 3266
  TaSBEIIa-D allele with mutations introduced by TALEN pair TaSBEIIa_T03

SEQ ID NO: 4115 - DNA, 477 bp, Artificial; identical to SEQ ID NO: 3435
  TaSBEIIa-D allele with mutations introduced by TALEN pair TaSBEIIa_T03

SEQ ID NO: 4116 - DNA, 525 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctgggaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4117 - DNA, 468 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgcctgatgaaaccaaccacggatgcgtcaggtttcgagcttcttctatcagcattgtgcagtactgcactgccttgttcatttttgttagccttggccccgtgctggctcttgggccactgaa

SEQ ID NO: 4118 - DNA, 479 bp, Artificial; identical to SEQ ID NO: 3308
  TaSBEIIa-D allele with mutations introduced by TALEN pair TaSBEIIa_T03

SEQ ID NO: 4119 - DNA, 448 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcca

SEQ ID NO: 4120 - DNA, 479 bp, Artificial; identical to SEQ ID NO: 3371
  TaSBEIIa-D allele with mutations introduced by TALEN pair TaSBEIIa_T03

SEQ ID NO: 4121 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttgggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4122 - DNA, 510 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctggggaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 4123 - DNA, 557 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggttgaaagcctcaacttgattcgcaacaaaagatccgctctgatactccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4124 - DNA, 485 bp, Artificial; identical to SEQ ID NO: 3316
  TaSBEIIa-D allele with mutations introduced by TALEN pair TaSBEIIa_T03

SEQ ID NO: 4125 - DNA, 470 bp, Artificial; identical to SEQ ID NO: 3320
  TaSBEIIa-D allele with mutations introduced by TALEN pair TaSBEIIa_T03

SEQ ID NO: 4126 - DNA, 484 bp, Artificial; identical to SEQ ID NO: 3242
  TaSBEIIa-D allele with mutations introduced by TALEN pair TaSBEIIa_T03

SEQ ID NO: 4127 - DNA, 483 bp, Artificial; identical to SEQ ID NO: 3279
  TaSBEIIa-D allele with mutations introduced by TALEN pair TaSBEIIa_T03

SEQ ID NO: 4128 - DNA, 485 bp, Artificial; identical to SEQ ID NO: 3515
  TaSBEIIa-D allele with mutations introduced by TALEN pair TaSBEIIa_T03

SEQ ID NO: 4129 - DNA, 483 bp, Artificial; identical to SEQ ID NO: 4045
  TaSBEIIa-D allele with mutations introduced by TALEN pair TaSBEIIa_T03

SEQ ID NO: 4130 - DNA, 484 bp, Artificial; identical to SEQ ID NO: 3242
  TaSBEIIa-D allele with mutations introduced by TALEN pair TaSBEIIa_T03

SEQ ID NO: 4131 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4132 - DNA, 423 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagcgcctgcttgccgccatcgtggctggcgatggccaccacctgctccgggtcaagccgtgggcctggcacagcaccggcaacagccgctgggatcttcacctagatccttttaaattaaaaatgaagttttaaatcaatctaaggtcctggtgcctgacggcgagagcgacgacttggc

SEQ ID NO: 4133 - DNA, 484 bp, Artificial; identical to SEQ ID NO: 3242
  TaSBEIIa-D allele with mutations introduced by TALEN pair TaSBEIIa_T03

SEQ ID NO: 4134 - DNA, 581 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagacggtgcaggcgctgttgccggtgctgtgccaggcccacggctttgacccccggagcaggtggtggccatcgccagccacgatggcggcaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4135 - DNA, 545 bp, Artificial; identical to SEQ ID NO: 3671
  TaSBEIIa-D allele with mutations introduced by TALEN pair TaSBEIIa_T03

SEQ ID NO: 4136 - DNA, 479 bp, Artificial; identical to SEQ ID NO: 3308
  TaSBEIIa-D allele with mutations introduced by TALEN pair TaSBEIIa_T03

SEQ ID NO: 4137 - DNA, 452 bp, Artificial
  TaSBEIIa-D allele with mutations introduced by TALEN pair TaSBEIIa_T03
  misc_feature (447): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaatcttcatacaatcgttattcacttaccaaaatgccggatgaaaccaaccacggatgcgtcaggttttcgagcttcttctacagcattgtgcagtactgcactgccttgttcatttttgttagccttggcccccgngctgg

SEQ ID NO: 4138 - DNA, 484 bp, Artificial; identical to SEQ ID NO: 3242
  TaSBEIIa-D allele with mutations introduced by TALEN pair TaSBEIIa_T03

SEQ ID NO: 4139 - DNA, 614 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagcgcctgcttgccgccatcgtggctggcgatggccaccacctgctccggggtcaagccgtgggcctggcacagcaccggcaacagccgctgggatcttcacctagatccttttaaattaaaaatgaagttttaaatcaatctaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcatttttgttagccttggccccgtgctgg

SEQ ID NO: 4140 - DNA, 482 bp, Artificial; identical to SEQ ID NO: 3572
  TaSBEIIa-D allele with mutations introduced by TALEN pair TaSBEIIa_T03

SEQ ID NO: 4141 - DNA, 483 bp, Artificial; identical to SEQ ID NO: 3469
  TaSBEIIa-D allele with mutations introduced by TALEN pair TaSBEIIa_T03

SEQ ID NO: 4142 - DNA, 476 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaccaaccacggatgcgtcaggtttcgagcttcttctatcagcattgtgcagtactgcactgccttgttcattttgttagccttggccccgtgctggctcttgggccactgaa

SEQ ID NO: 4143 - DNA, 483 bp, Artificial; identical to SEQ ID NO: 3279
  TaSBEIIa-D allele with mutations introduced by TALEN pair TaSBEIIa_T03

SEQ ID NO: 4144 - DNA, 455 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 4145 - DNA, 476 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgtctggctcttgggccactg

SEQ ID NO: 4146 - DNA, 542 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattacgcgcagaaaaaacaggaaggcaaaatgccgcaaaaaggggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctc

SEQ ID NO: 4147 - DNA, 432 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctacagcattgtgcagtactgcactgccttgttcattttgttagcttggccccg

SEQ ID NO: 4148 - DNA, 480 bp, Artificial; identical to SEQ ID NO: 3284
  TaSBEIIa-D allele with mutations introduced by TALEN pair TaSBEIIa_T03

SEQ ID NO: 4149 - DNA, 450 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccccgtgctggctcttggg

SEQ ID NO: 4150 - DNA, 483 bp, Artificial; identical to SEQ ID NO: 3469
  TaSBEIIa-D allele with mutations introduced by TALEN pair TaSBEIIa_T03

SEQ ID NO: 4151 - DNA, 424 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactgccttgttca

SEQ ID NO: 4152 - DNA, 478 bp, Artificial; identical to SEQ ID NO: 3395
  TaSBEIIa-D allele with mutations introduced by TALEN pair TaSBEIIa_T03

SEQ ID NO: 4153 - DNA, 446 bp, Artificial
  TaSBEIIa-D allele with mutations introduced by TALEN pair TaSBEIIa_T03
gagatagctggattaggcgatcgcgcttcctgaacctgtattttttccccgcggggaaatgcggttagtgtcacccaggccctggtgttaccacggctttgatcattcctcgtttcattctgatatatattttctcactctttttcttcctgttcttgctgtaactgcaagttgtggcgttttttcactattatagtcatcctttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttca

SEQ ID NO: 4154 - DNA, 480 bp, Artificial; identical to SEQ ID NO: 3284
  TaSBEIIa-D allele with mutations introduced by TALEN pair TaSBEIIa_T03

SEQ ID NO: 4155 - DNA, 440 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctc

SEQ ID NO: 4156 - DNA, 484 bp, Artificial; identical to SEQ ID NO: 3242
  TaSBEIIa-D allele with mutations introduced by TALEN pair TaSBEIIa_T03

SEQ ID NO: 4157 - DNA, 464 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 4158 - DNA, 485 bp, Artificial; identical to SEQ ID NO: 3379
  TaSBEIIa-D allele with mutations introduced by TALEN pair TaSBEIIa_T03

SEQ ID NO: 4159 - DNA, 479 bp, Artificial; identical to SEQ ID NO: 3326
  TaSBEIIa-D allele with mutations introduced by TALEN pair TaSBEIIa_T03

SEQ ID NO: 4160 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtctggtgctgacggcgagagcgacgacttggcaagtccggcgcacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4161 - DNA, 534 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaggccagcaaaaaggccggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4162 - DNA, 483 bp, Artificial; identical to SEQ ID NO: 3279
  TaSBEIIa-D allele with mutations introduced by TALEN pair TaSBEIIa_T03

SEQ ID NO: 4163 - DNA, 445 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 4164 - DNA, 484 bp, Artificial; identical to SEQ ID NO: 3242
  TaSBEIIa-D allele with mutations introduced by TALEN pair TaSBEIIa_T03

SEQ ID NO: 4165 - DNA, 523 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctggggaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggct

SEQ ID NO: 4166 - DNA, 526 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcacgacggccagtgaattcgagctcggtacctcgcgaatgcatctagatccatgcttccggctcgtatgttgtgtggaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctacagcattgtgcagtactgcactgccttgttcatttttgttag

SEQ ID NO: 4167 - DNA, 484 bp, Artificial; identical to SEQ ID NO: 3242
  TaSBEIIa-D allele with mutations introduced by TALEN pair TaSBEIIa_T03

SEQ ID NO: 4168 - DNA, 475 bp, Artificial
  TaSBEIIa-D allele with mutations introduced by TALEN pair TaSBEIIa_T03
gagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagcggcgagagcgacgacttggcaagtccggcggcaaacctgaagaaacttacaggtatcacacactcgtgccggtaaatcttcatacaatcgttattcacttaccaaatgccggatgaaaccaaccacggatgcgtcaggtttcgagcttcttctatcagcattgtgcaagtactgcactgccttgttcattttgttagccttggccccgtgctggctcttgggccactg

SEQ ID NO: 4169 - DNA, 483 bp, Artificial; identical to SEQ ID NO: 3221
  TaSBEIIa-D allele with mutations introduced by TALEN pair TaSBEIIa_T03

SEQ ID NO: 4170 - DNA, 468 bp, Artificial; identical to SEQ ID NO: 3775
  TaSBEIIa-D allele with mutations introduced by TALEN pair TaSBEIIa_T03

SEQ ID NO: 4171 - DNA, 523 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctgggaggtcctggtgcctgacggcgagagcgacgacttggcaagtccggcgcaacctgaagaattacaggtacacacactcgtgccggtaaatcttcatacaatcgttattcacttaccaatgccggatgaaaccaaccacggatgcgtcaggtttcgagcttcttctatcagcattgtgcagtactgcactgccttgttcatttgttagccttggccccgtgctggctctt

SEQ ID NO: 4172 - DNA, 485 bp, Artificial; identical to SEQ ID NO: 3515
  TaSBEIIa-D allele with mutations introduced by TALEN pair TaSBEIIa_T03

SEQ ID NO: 4173 - DNA, 454 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaatcttcatacaatcgttattcacttaccaaatgccggatgaaaccaaccacggaatgcgtcaggtttcgagcttcttctatcagcattgtgcagtactgcactgccttgtcattttgttagccttggccccgtgctggctctt

SEQ ID NO: 4174 - DNA, 421 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacggtacacacactcgtgccggtaaatcttcatacaatcgttattcacttaccaaaatgccggatgaaaccaaccacggattgccgtcaggtttcgagcttcttctacagcattgtgcagtactgcactgccttg

SEQ ID NO: 4175 - DNA, 612 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagccccgacacccgccaacacccgctgaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccgtgctggctcttgggccactgaa

SEQ ID NO: 4176 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4177 - DNA, 484 bp, Artificial; identical to SEQ ID NO: 3526
  TaSBEIIa-D allele with mutations introduced by TALEN pair TaSBEIIa_T03

SEQ ID NO: 4178 - DNA, 484 bp, Artificial; identical to SEQ ID NO: 3242
  TaSBEIIa-D allele with mutations introduced by TALEN pair TaSBEIIa_T03

SEQ ID NO: 4179 - DNA, 481 bp, Artificial; identical to SEQ ID NO: 3573
  TaSBEIIa-D allele with mutations introduced by TALEN pair TaSBEIIa_T03

SEQ ID NO: 4180 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4181 - DNA, 484 bp, Artificial; identical to SEQ ID NO: 3242
  TaSBEIIa-D allele with mutations introduced by TALEN pair TaSBEIIa_T03

SEQ ID NO: 4182 - DNA, 483 bp, Artificial; identical to SEQ ID NO: 3279
  TaSBEIIa-D allele with mutations introduced by TALEN pair TaSBEIIa_T03

SEQ ID NO: 4183 - DNA, 450 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactgccttgttcatttttgttagccttggcccccggctgg

SEQ ID NO: 4184 - DNA, 479 bp, Artificial; identical to SEQ ID NO: 3308
  TaSBEIIa-D allele with mutations introduced by TALEN pair TaSBEIIa_T03

SEQ ID NO: 4185 - DNA, 484 bp, Artificial; identical to SEQ ID NO: 3242
  TaSBEIIa-D allele with mutations introduced by TALEN pair TaSBEIIa_T03

SEQ ID NO: 4186 - DNA, 478 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4187 - DNA, 481 bp, Artificial; identical to SEQ ID NO: 3286
  TaSBEIIa-D allele with mutations introduced by TALEN pair TaSBEIIa_T03

SEQ ID NO: 4188 - DNA, 442 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4189 - DNA, 479 bp, Artificial; identical to SEQ ID NO: 3308
  TaSBEIIa-D allele with mutations introduced by TALEN pair TaSBEIIa_T03

SEQ ID NO: 4190 - DNA, 475 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaaggtcctggtgcctgacggcgagagcgacgactttgggcaagtccggcgcaaccctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4191 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggtcctggtgcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 4192 - DNA, 481 bp, Artificial; identical to SEQ ID NO: 3573
  TaSBEIIa-D allele with mutations introduced by TALEN pair TaSBEIIa_T03

SEQ ID NO: 4193 - DNA, 497 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 4194 - DNA, 484 bp, Artificial; identical to SEQ ID NO: 3242
  TaSBEIIa-D allele with mutations introduced by TALEN pair TaSBEIIa_T03

SEQ ID NO: 4195 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttggccactgaa

SEQ ID NO: 4196 - DNA, 461 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagctttcttctatcagcattgtgcagtactgcactgccttgttcattttgttagccttggccccgtgc

SEQ ID NO: 4197 - DNA, 484 bp, Artificial; identical to SEQ ID NO: 3242
  TaSBEIIa-D allele with mutations introduced by TALEN pair TaSBEIIa_T03

SEQ ID NO: 4198 - DNA, 612 bp, Artificial; identical to SEQ ID NO: 4175
  TaSBEIIa-D allele with mutations introduced by TALEN pair TaSBEIIa_T03

SEQ ID NO: 4199 - DNA, 417 bp, Artificial
  TaSBEIIa-D allele with mutations introduced by TALEN pair TaSBEIIa_T03
gagatagctggattaggcgatcgcgcttcctgaacctgtatttttccccgcgggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgcccggatgaaaccaaccacggattgcgtcaggtttcgagcttcttctatcagcaattgtgcaggtactgcactg

SEQ ID NO: 4200 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccacctggtgcctgacggcgagagcgacgacttggcaagtccggcgcaacctgaagaattacaggtacacacactcgtgccggtaaatcttcatacaatcgttattcactttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4201 - DNA, 479 bp, Artificial; identical to SEQ ID NO: 3308
  TaSBEIIa-D allele with mutations introduced by TALEN pair TaSBEIIa_T03

SEQ ID NO: 4202 - DNA, 484 bp, Artificial; identical to SEQ ID NO: 3240
  TaSBEIIa-D allele with mutations introduced by TALEN pair TaSBEIIa_T03

SEQ ID NO: 4203 - DNA, 478 bp, Artificial; identical to SEQ ID NO: 3395
  TaSBEIIa-D allele with mutations introduced by TALEN pair TaSBEIIa_T03

SEQ ID NO: 4204 - DNA, 484 bp, Artificial; identical to SEQ ID NO: 3242
  TaSBEIIa-D allele with mutations introduced by TALEN pair TaSBEIIa_T03

SEQ ID NO: 4205 - DNA, 483 bp, Artificial; identical to SEQ ID NO: 3280
  TaSBEIIa-D allele with mutations introduced by TALEN pair TaSBEIIa_T03

SEQ ID NO: 4206 - DNA, 470 bp, Artificial; identical to SEQ ID NO: 3320
  TaSBEIIa-D allele with mutations introduced by TALEN pair TaSBEIIa_T03

SEQ ID NO: 4207 - DNA, 510 bp, Artificial; identical to SEQ ID NO: 3869
  TaSBEIIa-D allele with mutations introduced by TALEN pair TaSBEIIa_T03

SEQ ID NO: 4208 - DNA, 484 bp, Artificial; identical to SEQ ID NO: 3239
  TaSBEIIa-D allele with mutations introduced by TALEN pair TaSBEIIa_T03

SEQ ID NO: 4209 - DNA, 483 bp, Artificial; identical to SEQ ID NO: 3279
  TaSBEIIa-D allele with mutations introduced by TALEN pair TaSBEIIa_T03

SEQ ID NO: 4210 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttgggcaagtccggcgcaaccctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4211 - DNA, 484 bp, Artificial; identical to SEQ ID NO: 3242
  TaSBEIIa-D allele with mutations introduced by TALEN pair TaSBEIIa_T03

SEQ ID NO: 4212 - DNA, 537 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagacggtgcaggcgctgttgccggtgctgtgccaggcccacggcttgaccccggagcaggtggtggccatcgccagccacgatggcggcaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 4213 - DNA, 477 bp, Artificial; identical to SEQ ID NO: 3435
  TaSBEIIa-D allele with mutations introduced by TALEN pair TaSBEIIa_T03

SEQ ID NO: 4214 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggccttcttcctggtgcctgacggcgagagcgacgactttggcaagtccggcgcaacctgaagaattacaggtacacacactcgtgccggtaaatcttcatacaatcgttattcactttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4215 - DNA, 484 bp, Artificial; identical to SEQ ID NO: 3242
  TaSBEIIa-D allele with mutations introduced by TALEN pair TaSBEIIa_T03

SEQ ID NO: 4216 - DNA, 484 bp, Artificial; identical to SEQ ID NO: 3242
  TaSBEIIa-D allele with mutations introduced by TALEN pair TaSBEIIa_T03

SEQ ID NO: 4217 - DNA, 458 bp, Artificial; identical to SEQ ID NO: 3390
  TaSBEIIa-D allele with mutations introduced by TALEN pair TaSBEIIa_T03

SEQ ID NO: 4218 - DNA, 483 bp, Artificial; identical to SEQ ID NO: 3279
  TaSBEIIa-D allele with mutations introduced by TALEN pair TaSBEIIa_T03

SEQ ID NO: 4219 - DNA, 483 bp, Artificial; identical to SEQ ID NO: 3279
  TaSBEIIa-D allele with mutations introduced by TALEN pair TaSBEIIa_T03

SEQ ID NO: 4220 - DNA, 527 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctc

SEQ ID NO: 4221 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcactttaccaaatgccggatgaaaccaaccacggatgcgtcaggtttcgagcttcttctatcagcattgtgcagtactgcactgccttgtgcagtttgttagctgtggccccgcgctggctcttgggccactgaa

SEQ ID NO: 4222 - DNA, 473 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgtctggctcttgggccactgaa

SEQ ID NO: 4223 - DNA, 481 bp, Artificial; identical to SEQ ID NO: 3573
  TaSBEIIa-D allele with mutations introduced by TALEN pair TaSBEIIa_T03

SEQ ID NO: 4224 - DNA, 483 bp, Artificial; identical to SEQ ID NO: 3279
  TaSBEIIa-D allele with mutations introduced by TALEN pair TaSBEIIa_T03

SEQ ID NO: 4225 - DNA, 482 bp, Artificial; identical to SEQ ID NO: 3522
  TaSBEIIa-D allele with mutations introduced by TALEN pair TaSBEIIa_T03

SEQ ID NO: 4226 - DNA, 484 bp, Artificial; identical to SEQ ID NO: 3242
  TaSBEIIa-D allele with mutations introduced by TALEN pair TaSBEIIa_T03

SEQ ID NO: 4227 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4228 - DNA, 483 bp, Artificial; identical to SEQ ID NO: 3279
  TaSBEIIa-D allele with mutations introduced by TALEN pair TaSBEIIa_T03

SEQ ID NO: 4229 - DNA, 484 bp, Artificial; identical to SEQ ID NO: 3242
  TaSBEIIa-D allele with mutations introduced by TALEN pair TaSBEIIa_T03

SEQ ID NO: 4230 - DNA, 481 bp, Artificial; identical to SEQ ID NO: 3336
  TaSBEIIa-D allele with mutations introduced by TALEN pair TaSBEIIa_T03

SEQ ID NO: 4231 - DNA, 484 bp, Artificial; identical to SEQ ID NO: 3242
  TaSBEIIa-D allele with mutations introduced by TALEN pair TaSBEIIa_T03

SEQ ID NO: 4232 - DNA, 479 bp, Artificial; identical to SEQ ID NO: 3308
  TaSBEIIa-D allele with mutations introduced by TALEN pair TaSBEIIa_T03

SEQ ID NO: 4233 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4234 - DNA, 451 bp, Artificial; identical to SEQ ID NO: 3761
  TaSBEIIa-D allele with mutations introduced by TALEN pair TaSBEIIa_T03

SEQ ID NO: 4235 - DNA, 484 bp, Artificial; identical to SEQ ID NO: 3242
  TaSBEIIa-D allele with mutations introduced by TALEN pair TaSBEIIa_T03

SEQ ID NO: 4236 - DNA, 485 bp, Artificial; identical to SEQ ID NO: 3515
  TaSBEIIa-D allele with mutations introduced by TALEN pair TaSBEIIa_T03

SEQ ID NO: 4237 - DNA, 483 bp, Artificial; identical to SEQ ID NO: 3279
  TaSBEIIa-D allele with mutations introduced by TALEN pair TaSBEIIa_T03

SEQ ID NO: 4238 - DNA, 464 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgagcggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 4239 - DNA, 484 bp, Artificial; identical to SEQ ID NO: 3242
  TaSBEIIa-D allele with mutations introduced by TALEN pair TaSBEIIa_T03

SEQ ID NO: 4240 - DNA, 456 bp, Artificial; identical to SEQ ID NO: 3581
  TaSBEIIa-D allele with mutations introduced by TALEN pair TaSBEIIa_T03

SEQ ID NO: 4241 - DNA, 531 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccgcggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggttgaaagcctcaacttgattcgcaacaaaagaatccgctctgatactccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 4242 - DNA, 504 bp, Artificial
  TaSBEIIa-D allele with mutations introduced by TALEN pair TaSBEIIa_T03
  misc_feature (428): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattatcgcgcagaaaaaacaggaaggcaaaatgccgcaaaaaggggaaggtcctggtgcctgacggcgagagcgacgacttggcaagtccggcgcaacctgaagaattacaggtacacacactcgtgccggtaaatcttcatacaatcgttattcacttnccaaatgccggatgaaaccaaccacggatgcgtcaggtttcgagcttcttctatcagcattgtgcagtactgcact

SEQ ID NO: 4243 - DNA, 484 bp, Artificial; identical to SEQ ID NO: 3242
  TaSBEIIa-D allele with mutations introduced by TALEN pair TaSBEIIa_T03

SEQ ID NO: 4244 - DNA, 474 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4245 - DNA, 480 bp, Artificial
  TaSBEIIa-D allele with mutations introduced by TALEN pair TaSBEIIa_T03
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4246 - DNA, 521 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgactggtgagtactcaaccaagtcattctgagaatagtcagcatgttcactacggaacaagtcggaataaagctagaaaggtcctggtgcctgacggcgagagcgacgacttggcaagtccggcgcaacctgaagaattacaggtacacacactcgtgccggtaaatcttcatacaatcgttattcacttaccaaatgccggtgaaaccaaccacggatgcgtcaggtttcgagcttcttctatcagcattgtgcagtactgcactgccttgttca

SEQ ID NO: 4247 - DNA, 467 bp, Artificial; identical to SEQ ID NO: 3372
  TaSBEIIa-D allele with mutations introduced by TALEN pair TaSBEIIa_T03

SEQ ID NO: 4248 - DNA, 520 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattacgcgcagaaaaaacaggaaggcaaaatgccgcaaaaaaggggaaggtcctggtgcctgacggcgagagcgacgacttggcaagtccggcgcaacctgaagaattacaggtacacacactcgtgccggtaaatcttcatacaatcgttattcactttaccaaatgccggatgaaaccaaccacggatgcgtcaggtttcgagcttcttctatcagcattgtgcagtactgcactgccttgttcattttg

SEQ ID NO: 4249 - DNA, 517 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcccggagcaggtggtggccatcgccagccacgatggcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttggg

SEQ ID NO: 4250 - DNA, 580 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagacggtgcaggcgctgttgccggtgctgtgccaggcccacggctttgaccccggagcaggtggtggccatcgccagccacgatggcggcaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4251 - DNA, 484 bp, Artificial; identical to SEQ ID NO: 3526
  TaSBEIIa-D allele with mutations introduced by TALEN pair TaSBEIIa_T03

SEQ ID NO: 4252 - DNA, 522 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattacgcgcagaaaaaacaggaaggcaaaatgccgcaaaaaaggggaaggtcctggtgcctgacggcgagagcgacgacttggcaagtccggcgcaacctgaagaattacaggtacacacactcgtgccggtaaatcttcatacaatcgttattcactttaccaaaatgccgggatgaaaccaaccacggatgcgtcaggtttcgagcttcttctatcagcattgtgcagtactgcactgccttgttcattttg

SEQ ID NO: 4253 - DNA, 485 bp, Artificial; identical to SEQ ID NO: 4227
  TaSBEIIa-D allele with mutations introduced by TALEN pair TaSBEIIa_T03

SEQ ID NO: 4254 - DNA, 483 bp, Artificial; identical to SEQ ID NO: 3279
  TaSBEIIa-D allele with mutations introduced by TALEN pair TaSBEIIa_T03

SEQ ID NO: 4255 - DNA, 484 bp, Artificial; identical to SEQ ID NO: 3242
  TaSBEIIa-D allele with mutations introduced by TALEN pair TaSBEIIa_T03

SEQ ID NO: 4256 - DNA, 470 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4257 - DNA, 451 bp, Artificial; identical to SEQ ID NO: 3761
  TaSBEIIa-D allele with mutations introduced by TALEN pair TaSBEIIa_T03

SEQ ID NO: 4258 - DNA, 485 bp, Artificial; identical to SEQ ID NO: 3515
  TaSBEIIa-D allele with mutations introduced by TALEN pair TaSBEIIa_T03

SEQ ID NO: 4259 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtgcattttgttagccgtggccccgtgctggctcttgggccactgaa

SEQ ID NO: 4260 - DNA, 483 bp, Artificial; identical to SEQ ID NO: 3279
  TaSBEIIa-D allele with mutations introduced by TALEN pair TaSBEIIa_T03

SEQ ID NO: 4261 - DNA, 484 bp, Artificial; identical to SEQ ID NO: 3242
  TaSBEIIa-D allele with mutations introduced by TALEN pair TaSBEIIa_T03

SEQ ID NO: 4262 - DNA, 453 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggttttcgagcttcttctatcagcattgtgcagtactgcactgccttgttcattttgttagccttggcccccgtgctgg

SEQ ID NO: 4263 - DNA, 483 bp, Artificial; identical to SEQ ID NO: 3280
  TaSBEIIa-D allele with mutations introduced by TALEN pair TaSBEIIa_T03

SEQ ID NO: 4264 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcatcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4265 - DNA, 479 bp, Artificial; identical to SEQ ID NO: 3371
  TaSBEIIa-D allele with mutations introduced by TALEN pair TaSBEIIa_T03

SEQ ID NO: 4266 - DNA, 558 bp, Artificial; identical to SEQ ID NO: 3697
  TaSBEIIa-D allele with mutations introduced by TALEN pair TaSBEIIa_T03

SEQ ID NO: 4267 - DNA, 569 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgacaccggataaggcgcagcgtcgggctgaacgggggttcgggcgatctcgatcagctcgatgtacaaggtcctggtgcctgacggcgagagcgacgacttggcaagtccggcgcaacctgaagaattgacaggtacacacactcgtgccggtaaatcttcatacaatcgttattcacttaccaaatgccggatgaaaccaaccacggatgcgtcaggtttcgagcttcttctatcagcattgtgcagtactgcactgccttgttc

SEQ ID NO: 4268 - DNA, 514 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattatcgcgcagaaaaaacaggaaggcaaaatgccgcaaaaaaggggaaggtcctggtgcctgacggcgagagcgacgacttggcaagtccggcgcaacctgaagaattacaggtacacacactcgtgccggtaaatcttcatacaatcgttattcacttaccaaatgccgggatgaaaccaaccacggatgcgtcaggtttcgagcttcttctatcagcattgtgcagtactgcactgccttgtc

SEQ ID NO: 4269 - DNA, 484 bp, Artificial; identical to SEQ ID NO: 3242
  TaSBEIIa-D allele with mutations introduced by TALEN pair TaSBEIIa_T03

SEQ ID NO: 4270 - DNA, 484 bp, Artificial; identical to SEQ ID NO: 3242
  TaSBEIIa-D allele with mutations introduced by TALEN pair TaSBEIIa_T03

SEQ ID NO: 4271 - DNA, 486 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactg

SEQ ID NO: 4272 - DNA, 419 bp, Artificial
  TaSBEIIa-D allele with mutations introduced by TALEN pair TaSBEIIa_T03
gagatagctggattaggcgatcgcgcttcctgaacctgtattttttccccgctgggaagtgcgttagtgtcacccaggccctggtgttaccacggctttgatcattcctcgtttcattctgatatatattttctcactctttttcttccgttcttgctgtaactgcaagttgtggcgttttttcacttattgtagtcatccttgcattttgcaggcgcctgtcctgagccgcgcggcctctggtcctggtgcctgacggcgagagcgaccgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtg

SEQ ID NO: 4273 - DNA, 510 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattatcgcgcagaaaaaacaggaaggcaaaatgccgcaaaaaggggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttg

SEQ ID NO: 4274 - DNA, 482 bp, Artificial; identical to SEQ ID NO: 3313
  TaSBEIIa-D allele with mutations introduced by TALEN pair TaSBEIIa_T03

SEQ ID NO: 4275 - DNA, 483 bp, Artificial; identical to SEQ ID NO: 3279
  TaSBEIIa-D allele with mutations introduced by TALEN pair TaSBEIIa_T03

SEQ ID NO: 4276 - DNA, 491 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaaggtcctggtgcctgacggcgagagcgacgacttggcaagtccggcgcaacctgaagaattacaggtacacacactcgtgccggtaaatcttcatacaatcgttattcacttaccaaatgccggatgaacaaccacggtgcgtcaggttcgagctcttctatcagcattgtgcagtactgcactgccttgtca

SEQ ID NO: 4277 - DNA, 471 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctgctgc

SEQ ID NO: 4278 - DNA, 580 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagacggtgcaggcgctgttgccggtgctgtgccaggcccacggctttgaccccggagcaggtggtggccatcgccagccacgatggcggcaagcaaggtcctggtgcctgacggcgagagcgacgacttggcaagtccggcgcacctgaagaattacagggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4279 - DNA, 471 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4280 - DNA, 445 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactgccttgttcatttttgttagccttggcccccg

SEQ ID NO: 4281 - DNA, 483 bp, Artificial; identical to SEQ ID NO: 3279
  TaSBEIIa-D allele with mutations introduced by TALEN pair TaSBEIIa_T03

SEQ ID NO: 4282 - DNA, 484 bp, Artificial; identical to SEQ ID NO: 3240
  TaSBEIIa-D allele with mutations introduced by TALEN pair TaSBEIIa_T03

SEQ ID NO: 4283 - DNA, 561 bp, Artificial
  TaSBEIIa-D allele with mutations introduced by TALEN pair TaSBEIIa_T03
  misc_feature (426): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcacgacggccagtgaattcgagctcggtacctcgcgaatgcatctagatccatgcttccggctcgtatgttgtgtggaggtcctggtgcctgacggcgagagcgacgacttggcaagtccggcgcaacctgaagaattacaggtacacacactcgtgccggtaaatcttcatacaatcgttattcncttaccaaatgcccggatgaaaaccaaccacggatgcgtcaggtttcgagcttcttctatcagcattgtgcagtactgcactgccttgttcatttttgttagccttggccccgtgctggctcttgggccactgaa

SEQ ID NO: 4284 - DNA, 485 bp, Artificial; identical to SEQ ID NO: 4227
  TaSBEIIa-D allele with mutations introduced by TALEN pair TaSBEIIa_T03

SEQ ID NO: 4285 - DNA, 483 bp, Artificial; identical to SEQ ID NO: 3279
  TaSBEIIa-D allele with mutations introduced by TALEN pair TaSBEIIa_T03

SEQ ID NO: 4286 - DNA, 517 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattatcgcgcagaaaaaacaggaaggcaaaatgccgcaaaaaaggggaaggtcctggtgcctgacggcgagagcgacgacttggcaagtccggcgcaacctgaagaattacaggtacacacactcgtgccggtaaatcttcatacaatcgttattcacttaccaaaatgccgggatgaaaccaaccacggatgcgtcaggtttcgagcttcttctatcagcattgtgcagtactgcactgccttgttca

SEQ ID NO: 4287 - DNA, 483 bp, Artificial
  TaSBEIIa-D allele with mutations introduced by TALEN pair TaSBEIIa_T03
gagatagctggattaggcgatcgcgcttcctgaacctgtattttttcccgcggggaaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgtctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4288 - DNA, 469 bp, Artificial; identical to SEQ ID NO: 3440
  TaSBEIIa-D allele with mutations introduced by TALEN pair TaSBEIIa_T03

SEQ ID NO: 4289 - DNA, 484 bp, Artificial
  TaSBEIIa-D allele with mutations introduced by TALEN pair TaSBEIIa_T03
  misc_feature (410): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaggtcctggtgcctgacggcgagagcgacgacttggcaagtccggcgcaacctgaagaattacaggtacacacactcgtgccggtaaatcttcatacaatcgttattcacttnccaaatgccgggatgaaaccaaccacggatgcgtcaggtttcgagcttcttctatcagcattgtgcagtactgc

SEQ ID NO: 4290 - DNA, 441 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctgg

SEQ ID NO: 4291 - DNA, 484 bp, Artificial; identical to SEQ ID NO: 3242
  TaSBEIIa-D allele with mutations introduced by TALEN pair TaSBEIIa_T03

SEQ ID NO: 4292 - DNA, 463 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggttttttgtttgcaagcagcagattatcgcgcagaaaaacaggaaggcaaaatgccgcaaaaaggggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcagg

SEQ ID NO: 4293 - DNA, 547 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgtaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaaatgccgcaaaaagcaaggtcctggtgcctgacggcgagagcgacgacttggcaagtccggcgcaacctgaagaattacaggtacacacactcgtgccggtaaaatcttcatacaatcgttattcacttaccaaatgccggatgaaaccaaccacggatgcgtcaggtttcgagcttcttctatcagc

SEQ ID NO: 4294 - DNA, 544 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggagccgcccaggtgcttgcccctgtagccgtacaccggcaacagccgctggaccgtctccagcgcctgcttgccaccattattgctgaaggtcctggtgcctgacggcgagagcgacgacttggcaagtccggcgcaacctgagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 4295 - DNA, 483 bp, Artificial; identical to SEQ ID NO: 3279
  TaSBEIIa-D allele with mutations introduced by TALEN pair TaSBEIIa_T03

SEQ ID NO: 4296 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggctttgttttcactattgtagtcatccttgcattttgcaggcgccgtcctgagccgcgcggcctctgcagtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4297 - DNA, 436 bp, Artificial
  TaSBEIIa-D allele with mutations introduced by TALEN pair TaSBEIIa_T03
  misc_feature (274): n is a or c or t or g
gagatagctggattaggcgatcgcgcttcctgaacctgtattttttcccgcgggaagatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccagtgactggtgagtactcaaccaagtcattctgngaatagtcagcatgttcactacggaacaagtcggaataaagctagaaaggtcctggtgcctgacggcgagagcgacgacttggcaagtccggcgcaacctgaagaattacggtacacacacttcgtgccggtaaatcttcatacaatcgttattcacttacc

SEQ ID NO: 4298 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4299 - DNA, 484 bp, Artificial; identical to SEQ ID NO: 3242
  TaSBEIIa-D allele with mutations introduced by TALEN pair TaSBEIIa_T03

SEQ ID NO: 4300 - DNA, 613 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagccccgacacccgcccaacacccgctgaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccgtgctggctcttgggccactgaa

SEQ ID NO: 4301 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 4302 - DNA, 482 bp, Artificial; identical to SEQ ID NO: 3313
  TaSBEIIa-D allele with mutations introduced by TALEN pair TaSBEIIa_T03

SEQ ID NO: 4303 - DNA, 473 bp, Artificial; identical to SEQ ID NO: 3542
  TaSBEIIa-D allele with mutations introduced by TALEN pair TaSBEIIa_T03

SEQ ID NO: 4304 - DNA, 483 bp, Artificial; identical to SEQ ID NO: 3221
  TaSBEIIa-D allele with mutations introduced by TALEN pair TaSBEIIa_T03

SEQ ID NO: 4305 - DNA, 484 bp, Artificial; identical to SEQ ID NO: 3242
  TaSBEIIa-D allele with mutations introduced by TALEN pair TaSBEIIa_T03

SEQ ID NO: 4306 - DNA, 479 bp, Artificial; identical to SEQ ID NO: 3307
  TaSBEIIa-D allele with mutations introduced by TALEN pair TaSBEIIa_T03

SEQ ID NO: 4307 - DNA, 558 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtagctcttgatccggcaaacaaaccaccgcgccttgcagcacatccccttcgccagctggcgtaatagcgaaaggtcctggtgcctgacggcgagagcgacgacttggcaagtccggcgcaacctgaagaattacaggtacacacactcgtgccggtaaatcttcatacaatcgttattcacttaccaaaatgccggtgaaaccaaccacggatgcgtcaggtttcgagcttcttctatcagcattgtgcagtactgcactgccttgttcattttgttagccttggccccgtgctggctcttgggccactgaa

SEQ ID NO: 4308 - DNA, 512 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgacaccggataaggcgcagcgtcgggctgaacgggggttcgggcatctcgatcagctcgatgtacaaggtcctggtgcctgacggcgagagcgacgacttggcaagtccggcgcaacctgaagaattacaggtacacacactcgtgccggtaaatcttcatacaatcgttattcacttccaaatgccggatgaaaccaaccacggatgc

SEQ ID NO: 4309 - DNA, 484 bp, Artificial; identical to SEQ ID NO: 3242
  TaSBEIIa-D allele with mutations introduced by TALEN pair TaSBEIIa_T03

SEQ ID NO: 4310 - DNA, 479 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4311 - DNA, 479 bp, Artificial; identical to SEQ ID NO: 3326
  TaSBEIIa-D allele with mutations introduced by TALEN pair TaSBEIIa_T03

SEQ ID NO: 4312 - DNA, 470 bp, Artificial; identical to SEQ ID NO: 3320
  TaSBEIIa-D allele with mutations introduced by TALEN pair TaSBEIIa_T03

SEQ ID NO: 4313 - DNA, 469 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacgcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4314 - DNA, 481 bp, Artificial; identical to SEQ ID NO: 3336
  TaSBEIIa-D allele with mutations introduced by TALEN pair TaSBEIIa_T03

SEQ ID NO: 4315 - DNA, 466 bp, Artificial; identical to SEQ ID NO: 3343
  TaSBEIIa-D allele with mutations introduced by TALEN pair TaSBEIIa_T03

SEQ ID NO: 4316 - DNA, 472 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4317 - DNA, 441 bp, Artificial; identical to SEQ ID NO: 3867
  TaSBEIIa-D allele with mutations introduced by TALEN pair TaSBEIIa_T03

SEQ ID NO: 4318 - DNA, 483 bp, Artificial; identical to SEQ ID NO: 3279
  TaSBEIIa-D allele with mutations introduced by TALEN pair TaSBEIIa_T03

SEQ ID NO: 4319 - DNA, 469 bp, Artificial; identical to SEQ ID NO: 3378
  TaSBEIIa-D allele with mutations introduced by TALEN pair TaSBEIIa_T03

SEQ ID NO: 4320 - DNA, 472 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4321 - DNA, 482 bp, Artificial; identical to SEQ ID NO: 3313
  TaSBEIIa-D allele with mutations introduced by TALEN pair TaSBEIIa_T03

SEQ ID NO: 4322 - DNA, 470 bp, Artificial; identical to SEQ ID NO: 3580
  TaSBEIIa-D allele with mutations introduced by TALEN pair TaSBEIIa_T03

SEQ ID NO: 4323 - DNA, 529 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggagccgcccaggtgcttgccctgtagccgtacaccggcaacagccgctggaccgtctccagcgcctgcttgccaccattattgctgaaggtcctggtgccctgacggcgagagcgacgacttggcaagtccggcgcaacctgagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 4324 - DNA, 484 bp, Artificial; identical to SEQ ID NO: 3242
  TaSBEIIa-D allele with mutations introduced by TALEN pair TaSBEIIa_T03

SEQ ID NO: 4325 - DNA, 492 bp, Artificial; identical to SEQ ID NO: 3394
  TaSBEIIa-D allele with mutations introduced by TALEN pair TaSBEIIa_T03

SEQ ID NO: 4326 - DNA, 545 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaaggccagcaaaaaggccaggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 4327 - DNA, 484 bp, Artificial; identical to SEQ ID NO: 3242
  TaSBEIIa-D allele with mutations introduced by TALEN pair TaSBEIIa_T03

SEQ ID NO: 4328 - DNA, 484 bp, Artificial; identical to SEQ ID NO: 3239
  TaSBEIIa-D allele with mutations introduced by TALEN pair TaSBEIIa_T03

SEQ ID NO: 4329 - DNA, 476 bp, Artificial; identical to SEQ ID NO: 3568
  TaSBEIIa-D allele with mutations introduced by TALEN pair TaSBEIIa_T03

SEQ ID NO: 4330 - DNA, 479 bp, Artificial; identical to SEQ ID NO: 3371
  TaSBEIIa-D allele with mutations introduced by TALEN pair TaSBEIIa_T03

SEQ ID NO: 4331 - DNA, 483 bp, Artificial; identical to SEQ ID NO: 3279
  TaSBEIIa-D allele with mutations introduced by TALEN pair TaSBEIIa_T03

SEQ ID NO: 4332 - DNA, 448 bp, Artificial; identical to SEQ ID NO: 4051
  TaSBEIIa-D allele with mutations introduced by TALEN pair TaSBEIIa_T03

SEQ ID NO: 4333 - DNA, 482 bp, Artificial; identical to SEQ ID NO: 3313
  TaSBEIIa-D allele with mutations introduced by TALEN pair TaSBEIIa_T03

SEQ ID NO: 4334 - DNA, 559 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggttgaaagcctcaacttgattcgcaacaaaaagatccgctctgatactccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4335 - DNA, 483 bp, Artificial; identical to SEQ ID NO: 3279
  TaSBEIIa-D allele with mutations introduced by TALEN pair TaSBEIIa_T03

SEQ ID NO: 4336 - DNA, 544 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgacaccggataaggcgcagcggtcgggctgaacgggggttcgggcgatctcgatcagctcgatgtacaaggtcctggtgcctgacgggcgagagcgacgacttggcaagtccggcgcaacctgaagaattgacaggtacacacactcgtgccggtaaatcttcatacaatcgttattcacttaccaaatgccggatgaaaccaaccacggatgcgtcaggtttcgagcttcttctatcagca

SEQ ID NO: 4337 - DNA, 484 bp, Artificial; identical to SEQ ID NO: 3239
  TaSBEIIa-D allele with mutations introduced by TALEN pair TaSBEIIa_T03

SEQ ID NO: 4338 - DNA, 470 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4339 - DNA, 481 bp, Artificial; identical to SEQ ID NO: 4078
  TaSBEIIa-D allele with mutations introduced by TALEN pair TaSBEIIa_T03

SEQ ID NO: 4340 - DNA, 615 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagccccgacacccgccaacacccgctgaaggtcctggtgcctgacggcgagagcgacgacttggcaagtccggcgcaacctgaagaattacaggtacacacactcgtgccgggtaaatcttcatacaatcgttattcacttaccaaattgccggatgaaaccaaccacggatgcgtcaggtttcgagcttcttctatcagcattgtgcagtactgcactgccttgttcattttgttagccttggcccgtgctggctcttgggccactgaa

SEQ ID NO: 4341 - DNA, 464 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 4342 - DNA, 582 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagcgcctgcttgccgccatcgtggctggcgatggccaccacctgctccggggtcaagccgtgggcctggcacagcaccggcaacagccgctgggatcttcacctagatccttttaaattaaaaatgaagttttaaatcaatctaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacgggattgcgtcaggttttcgagcttcttctatcagcattgtgcagtactgcactgcc

SEQ ID NO: 4343 - DNA, 419 bp, Artificial; identical to SEQ ID NO: 3655
  TaSBEIIa-D allele with mutations introduced by TALEN pair TaSBEIIa_T03

SEQ ID NO: 4344 - DNA, 484 bp, Artificial; identical to SEQ ID NO: 3242
  TaSBEIIa-D allele with mutations introduced by TALEN pair TaSBEIIa_T03

SEQ ID NO: 4345 - DNA, 483 bp, Artificial; identical to SEQ ID NO: 3279
  TaSBEIIa-D allele with mutations introduced by TALEN pair TaSBEIIa_T03

SEQ ID NO: 4346 - DNA, 446 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcc

SEQ ID NO: 4347 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttctatacaatcgttattcactttaccaaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 4348 - DNA, 578 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagacggtgcaggcgctgttgccggtgctgtgccaggcccacggctttgaccccggagcaggtggtggccatcgccagccacgatggcggcaagcaaggtcctggtgcctgacggcgagagcgacgacttggcaagtccggcgcacctgagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4349 - DNA, 483 bp, Artificial; identical to SEQ ID NO: 3279
  TaSBEIIa-D allele with mutations introduced by TALEN pair TaSBEIIa_T03

SEQ ID NO: 4350 - DNA, 484 bp, Artificial; identical to SEQ ID NO: 3242
  TaSBEIIa-D allele with mutations introduced by TALEN pair TaSBEIIa_T03

SEQ ID NO: 4351 - DNA, 481 bp, Artificial; identical to SEQ ID NO: 3336
  TaSBEIIa-D allele with mutations introduced by TALEN pair TaSBEIIa_T03

SEQ ID NO: 4352 - DNA, 586 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgacaccggataaggcgcagcggtcgggctgaacgggggttcgggcgatctcgatcagctcgatgtacaaggtcctgggtgcctgacggcgagagcgacgacttggcaagtccggcgcaacctgaagaattgacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 4353 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4354 - DNA, 484 bp, Artificial; identical to SEQ ID NO: 3242
  TaSBEIIa-D allele with mutations introduced by TALEN pair TaSBEIIa_T03

SEQ ID NO: 4355 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattccttcgtttcattctgatattatattttctcactctttttcttcctgttcttgctgtaactgcaagttgtggcgttttttcactattgtagtcatccttgcattttgcaggcgccgtcctgagccgcgcggcctctcccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgtgcattttgttagccgtggccccgtgctggctcttgggccactgaa

SEQ ID NO: 4356 - DNA, 480 bp, Artificial; identical to SEQ ID NO: 3284
  TaSBEIIa-D allele with mutations introduced by TALEN pair TaSBEIIa_T03

SEQ ID NO: 4357 - DNA, 610 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaaatgccgcaaaaagcaaggtcctggtgcctgacggcgagagcgacgacttggcaagtccggcgcaacctgaagaattacaggtacacacactcgtgccggtaaaatcttcatacaatcgttattcacttaccaaatgccggatgaaaccaaccacggatgcgtcaggtttcgagcttcttctatcagcattgtgcagtactgcactgccttgttcattttgtttagccttggccccgtgctggctcttggg

SEQ ID NO: 4358 - DNA, 484 bp, Artificial; identical to SEQ ID NO: 3242
  TaSBEIIa-D allele with mutations introduced by TALEN pair TaSBEIIa_T03

SEQ ID NO: 4359 - DNA, 465 bp, Artificial
  TaSBEIIa-D allele with mutations introduced by TALEN pair TaSBEIIa_T03
gagatagctggattaggcgatcgcgcttcctgaacctgtattttttccccgcgggaacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggttttcgagcttcttctatcagcattgtgcagtactgcactgccttgttcattttgttagccttggccccgtgctggtcttgggccact

SEQ ID NO: 4360 - DNA, 502 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttg

SEQ ID NO: 4361 - DNA, 478 bp, Artificial; identical to SEQ ID NO: 3395
  TaSBEIIa-D allele with mutations introduced by TALEN pair TaSBEIIa_T03

SEQ ID NO: 4362 - DNA, 483 bp, Artificial; identical to SEQ ID NO: 3279
  TaSBEIIa-D allele with mutations introduced by TALEN pair TaSBEIIa_T03

SEQ ID NO: 4363 - DNA, 482 bp, Artificial; identical to SEQ ID NO: 4131
  TaSBEIIa-D allele with mutations introduced by TALEN pair TaSBEIIa_T03

SEQ ID NO: 4364 - DNA, 471 bp, Artificial; identical to SEQ ID NO: 4279
  TaSBEIIa-D allele with mutations introduced by TALEN pair TaSBEIIa_T03

SEQ ID NO: 4365 - DNA, 473 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4366 - DNA, 458 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccctggtgcctgacggcgagagcgacgacttggcaagtccggcgcaacctgaagaattacaggtacacacactcgtgccggtaaatcttcatacaatcgttattcacttaccaaatatcggatgaaccaagccgcggaggcatcaggtttcaagcttcttctatcagcattgtgcactacttcactgccttgtgcagtttgttagctgtggcccccg

SEQ ID NO: 4367 - DNA, 451 bp, Artificial
  TaSBEIIa-D allele with mutations introduced by TALEN pair TaSBEIIa_T03
gagatagctggattaggcgatcgcgcttcctgaacctgtattttttccccgcggggaaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 4368 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4369 - DNA, 485 bp, Artificial; identical to SEQ ID NO: 3501
  TaSBEIIa-D allele with mutations introduced by TALEN pair TaSBEIIa_T03

SEQ ID NO: 4370 - DNA, 461 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactgccttgttcattttgttagccttggccccgtgctggtcttgggccac

SEQ ID NO: 4371 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4372 - DNA, 487 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgactttggcaagtccggcgcaacctgaagaattacaggtacacacactcgtgccggtaaatcttcatacaatcgttattcactttaccaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 4373 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgaccgactttggcaagtccggcgcaacctgaagaattacaggtacacacactcgtgccggtaaatcttcatacaatcgttattcactttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4374 - DNA, 510 bp, Artificial
  TaSBEIIa-D allele with mutations introduced by TALEN pair TaSBEIIa_T03
  misc_feature (428): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattatcgcgcagaaaaaacaggaaggcaaaatgccgcaaaaaaggggaaggtcctggtgcctgacggcgagagcgacgacttggcaagtccggcgcaacctgaagaattacaggtacacacactcgtgccggtaaatcttcatacaatcgttatcacttnccaaatgccggatgaaaccaaccacggatgcgtcaggtttcgagcttcttctatcagcattgtgcagtactgcactgccttg

SEQ ID NO: 4375 - DNA, 509 bp, Artificial; identical to SEQ ID NO: 3965
  TaSBEIIa-D allele with mutations introduced by TALEN pair TaSBEIIa_T03

SEQ ID NO: 4376 - DNA, 425 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttca

SEQ ID NO: 4377 - DNA, 534 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgactggtgagtactcaaccaagtcattctgagaatagtcagcatgttcactacggaacaagtcggaataaaagctaagaaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctacagcattgtgcagtactgcactgccttgttcatttttgttag

SEQ ID NO: 4378 - DNA, 451 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttag

SEQ ID NO: 4379 - DNA, 495 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcacgacggccagtgaattcgagctcggtacctcgcgaatgcatctagatccatgcttccggctcgtatgttgtgtggaggtcctggtgcctgacggcgagagcgacgacttggcaagtccggcgcaacctgaagaattacaggtacacacactcgtgccggtaaatcttcatacaatcggttattcacttacccaaatgccggtgaaaaccaaccacggatgcgtcaggttttcgagcttcttctacagcattg

SEQ ID NO: 4380 - DNA, 471 bp, Artificial; identical to SEQ ID NO: 4279
  TaSBEIIa-D allele with mutations introduced by TALEN pair TaSBEIIa_T03

SEQ ID NO: 4381 - DNA, 504 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaactgagctgccaaggcacaca

SEQ ID NO: 4382 - DNA, 455 bp, Artificial
  TaSBEIIa-D allele with mutations introduced by TALEN pair TaSBEIIa_T03
gagatagctggattaggcgatcgcgcttcctgaacctgtattttttccccgcggggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 4383 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4384 - DNA, 462 bp, Artificial
  TaSBEIIa-D allele with mutations introduced by TALEN pair TaSBEIIa_T03
  misc_feature (445): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactgccttgttcattttgttagccttggccccgngctggtcttgggccact

SEQ ID NO: 4385 - DNA, 451 bp, Artificial; identical to SEQ ID NO: 3646
  TaSBEIIa-D allele with mutations introduced by TALEN pair TaSBEIIa_T03

SEQ ID NO: 4386 - DNA, 484 bp, Artificial; identical to SEQ ID NO: 3239
  TaSBEIIa-D allele with mutations introduced by TALEN pair TaSBEIIa_T03

SEQ ID NO: 4387 - DNA, 571 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggagccgcccaggtgcttgcccctgtagccgtacaccggcaacagccgctggaccgtctccagcgcctgcttgccaccattattgctgaaggtcctggtgcctgacggcgagagcgacgacttggcaagtccggcgcaacctgagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4388 - DNA, 483 bp, Artificial; identical to SEQ ID NO: 3279
  TaSBEIIa-D allele with mutations introduced by TALEN pair TaSBEIIa_T03

SEQ ID NO: 4389 - DNA, 484 bp, Artificial; identical to SEQ ID NO: 3242
  TaSBEIIa-D allele with mutations introduced by TALEN pair TaSBEIIa_T03

SEQ ID NO: 4390 - DNA, 479 bp, Artificial; identical to SEQ ID NO: 3308
  TaSBEIIa-D allele with mutations introduced by TALEN pair TaSBEIIa_T03

SEQ ID NO: 4391 - DNA, 485 bp, Artificial; identical to SEQ ID NO: 3379
  TaSBEIIa-D allele with mutations introduced by TALEN pair TaSBEIIa_T03

SEQ ID NO: 4392 - DNA, 509 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaactagactgccaaggcacacaggggata

SEQ ID NO: 4393 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttatttcactttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4394 - DNA, 402 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaggtagctcttgatccggcaaacaaccaccgcgccttgcagcacatccccttcgccagctggcgtatagcgaaaggtcctggtgcctgacggcgagagcgacgacttggcaagtccggcgcaacctgaagaattacaggtacacacactcgtgccggtaaa

SEQ ID NO: 4395 - DNA, 433 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtacttgccatctgcc

SEQ ID NO: 4396 - DNA, 477 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4397 - DNA, 484 bp, Artificial; identical to SEQ ID NO: 3242
  TaSBEIIa-D allele with mutations introduced by TALEN pair TaSBEIIa_T03

SEQ ID NO: 4398 - DNA, 612 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgacaccggataaggcgcagcggtcgggctgaacgggggttcgggcgatctcgatcagctcgatgtacaaggtcctgggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4399 - DNA, 502 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttg

SEQ ID NO: 4400 - DNA, 484 bp, Artificial; identical to SEQ ID NO: 3242
  TaSBEIIa-D allele with mutations introduced by TALEN pair TaSBEIIa_T03

SEQ ID NO: 4401 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgactttggcaagtccggcgcaacctgaagaattacaggtacacacactcgtgccggtaaatcttcatacaatcgttattcactttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4402 - DNA, 509 bp, Artificial
  TaSBEIIa-D allele with mutations introduced by TALEN pair TaSBEIIa_T03
  misc_feature (411): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgttattcacttnccaatgccggatgaaccaaccacggatgcgtcaggtttcgagcttcttctatcagcattgtgcagtactgcactgccttgttcattttgtagccttgg

SEQ ID NO: 4403 - DNA, 424 bp, Artificial; identical to SEQ ID NO: 4151
  TaSBEIIa-D allele with mutations introduced by TALEN pair TaSBEIIa_T03

SEQ ID NO: 4404 - DNA, 431 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgattaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgaccgacttggcaagtccggcgcacctgaagaattacaaggtacacacactcgtgccggtaaatcttcatacaatcgttattcacttaccaaatgccggatgaaaccaaccacggatgcgtcaggtttcgagcttcttctatcagcattgtgcagtactgc

SEQ ID NO: 4405 - DNA, 611 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagccccgacacccgccaacacccgctgaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccgtgctggctcttgggccactgaa

SEQ ID NO: 4406 - DNA, 560 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggttgaaagcctcaacttgattcgcaacaaaaagaatccgctctgatactccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4407 - DNA, 484 bp, Artificial; identical to SEQ ID NO: 3242
  TaSBEIIa-D allele with mutations introduced by TALEN pair TaSBEIIa_T03

SEQ ID NO: 4408 - DNA, 394 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgcaccggataaggcgcagcggtcggctgaacgggggttcggcgatctcgatcagctcgatgtacaaggtcctggtgcctgacggcgagagcg

SEQ ID NO: 4409 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccact

SEQ ID NO: 4410 - DNA, 485 bp, Artificial; identical to SEQ ID NO: 3316
  TaSBEIIa-D allele with mutations introduced by TALEN pair TaSBEIIa_T03

SEQ ID NO: 4411 - DNA, 485 bp, Artificial; identical to SEQ ID NO: 3515
  TaSBEIIa-D allele with mutations introduced by TALEN pair TaSBEIIa_T03

SEQ ID NO: 4412 - DNA, 482 bp, Artificial; identical to SEQ ID NO: 3313
  TaSBEIIa-D allele with mutations introduced by TALEN pair TaSBEIIa_T03

SEQ ID NO: 4413 - DNA, 483 bp, Artificial; identical to SEQ ID NO: 3279
  TaSBEIIa-D allele with mutations introduced by TALEN pair TaSBEIIa_T03

SEQ ID NO: 4414 - DNA, 570 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggagccgcccaggtgcttgcccctgtagccgtacaccggcaacagccgctggaccgtctccagcgcctgcttgccaccattattgctgaaggtcctggtgcctgacggcgagagcgacgacttggcaagtccggcgcaactgagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4415 - DNA, 484 bp, Artificial; identical to SEQ ID NO: 3242
  TaSBEIIa-D allele with mutations introduced by TALEN pair TaSBEIIa_T03

SEQ ID NO: 4416 - DNA, 470 bp, Artificial; identical to SEQ ID NO: 3580
  TaSBEIIa-D allele with mutations introduced by TALEN pair TaSBEIIa_T03

SEQ ID NO: 4417 - DNA, 442 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4418 - DNA, 484 bp, Artificial; identical to SEQ ID NO: 3242
  TaSBEIIa-D allele with mutations introduced by TALEN pair TaSBEIIa_T03

SEQ ID NO: 4419 - DNA, 476 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccacctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccct

SEQ ID NO: 4420 - DNA, 440 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcacctgaagaattacaggtacacacactcgtgccggtaaatcttcatacaatcgttattcacttaccaaatgccggatgaaaccaacacggatgcgtcaggtttcgagcttcttctatcagcattgtgcagtactgcactgccttgttcattttgttagccttggccccgtgctggctctt

SEQ ID NO: 4421 - DNA, 484 bp, Artificial; identical to SEQ ID NO: 3239
  TaSBEIIa-D allele with mutations introduced by TALEN pair TaSBEIIa_T03

SEQ ID NO: 4422 - DNA, 450 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcaacctgaagaattacaggtacacacactcgtgccggtaaatcttcatacaatcgttattcacttaccaaatgccggatgaaccaaccacggatgcgtcaggtttcgagcttcttctatcagcattgtgcagtactgcactgccttgttcattttgttagccttggccccgtgctggctcttgggccactg

SEQ ID NO: 4423 - DNA, 483 bp, Artificial; identical to SEQ ID NO: 3363
  TaSBEIIa-D allele with mutations introduced by TALEN pair TaSBEIIa_T03

SEQ ID NO: 4424 - DNA, 451 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtctggtgctgacggcgagagcgacgacttggcaagtccggcgcacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagcctt

SEQ ID NO: 4425 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4426 - DNA, 494 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaaggtcctggtgcctgacggcgagagcgacgacttggcaagtccggcgcaacctgaagaattacaggtacacacactcgtgccggtaaatcttcatacaatcgttattcacttaccaaaatgccgggatgaaaccaaccacggatgcgtcaggtttcgagctcttctatcagcattgtgcagtactgcactgccttg

SEQ ID NO: 4427 - DNA, 474 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctctt

SEQ ID NO: 4428 - DNA, 483 bp, Artificial; identical to SEQ ID NO: 3279
  TaSBEIIa-D allele with mutations introduced by TALEN pair TaSBEIIa_T03

SEQ ID NO: 4429 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcacgacttggcaagtccggcgcaacctgaagaattacaggtacacacactcgtgccggtaaatcttcatacaatcgttattcactttaccaaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 4430 - DNA, 459 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggcccccgtgctggtcttggg

SEQ ID NO: 4431 - DNA, 484 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4432 - DNA, 479 bp, Artificial; identical to SEQ ID NO: 3326
  TaSBEIIa-D allele with mutations introduced by TALEN pair TaSBEIIa_T03

SEQ ID NO: 4433 - DNA, 483 bp, Artificial; identical to SEQ ID NO: 3279
  TaSBEIIa-D allele with mutations introduced by TALEN pair TaSBEIIa_T03

SEQ ID NO: 4434 - DNA, 484 bp, Artificial; identical to SEQ ID NO: 3242
  TaSBEIIa-D allele with mutations introduced by TALEN pair TaSBEIIa_T03

SEQ ID NO: 4435 - DNA, 493 bp, Artificial
  TaSBEIIa-D allele with mutations introduced by TALEN pair TaSBEIIa_T03
  misc_feature (411): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaaggtcctggtgcctgacggcgagagcgacgacttggcaagtccggcgcaacctgaagaattacaggtacacacactcgtgccggtaaatcttcatacaatcgttattcacttnccaaatgccgggatgaaaccaaccacggtgcgtcaggtttcgagctcttctatcagcatttgtgcagtactgcactgccttg

SEQ ID NO: 4436 - DNA, 451 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggcccccgtgctggctcttggg

SEQ ID NO: 4437 - DNA, 470 bp, Artificial; identical to SEQ ID NO: 4256
  TaSBEIIa-D allele with mutations introduced by TALEN pair TaSBEIIa_T03

SEQ ID NO: 4438 - DNA, 484 bp, Artificial; identical to SEQ ID NO: 3526
  TaSBEIIa-D allele with mutations introduced by TALEN pair TaSBEIIa_T03

SEQ ID NO: 4439 - DNA, 612 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgacaccggataaggcgcagcggtcgggctgaacgggggttcgggcgatctcgatcagctcgatgtacaaggtcctggtgcctgacggcgagagcgacgacttggcaagtccggcgcaacctgaagaattgacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccctgtgctggctcttgggccactgaa

SEQ ID NO: 4440 - DNA, 484 bp, Artificial; identical to SEQ ID NO: 3242
  TaSBEIIa-D allele with mutations introduced by TALEN pair TaSBEIIa_T03

SEQ ID NO: 4441 - DNA, 471 bp, Artificial; identical to SEQ ID NO: 4279
  TaSBEIIa-D allele with mutations introduced by TALEN pair TaSBEIIa_T03

SEQ ID NO: 4442 - DNA, 525 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctc

SEQ ID NO: 4443 - DNA, 478 bp, Artificial; identical to SEQ ID NO: 3395
  TaSBEIIa-D allele with mutations introduced by TALEN pair TaSBEIIa_T03

SEQ ID NO: 4444 - DNA, 561 bp, Artificial
  TaSBEIIa-D allele with mutations introduced by TALEN pair TaSBEIIa_T03
  misc_feature (427): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtagctcttgatccggcaaacaaaccaccgcgccttgcagcacatccccctttcgccagctggcgtatagcgaaaggtcctggtgcctgacggcgagagcgacgacttggcaagtccggcgcaacctgaagaattacaggtacacacactcgtgccggtaaatcttcatacaatcgttattcncttaccaaaatgccggtgaaaccaaccacggatgcgtcaggtttcgagcttcttctatcagcattgtgcaagtactgcactgccttgttcatttttgttagccttggccccgtgctggctcttgggccactgaa

SEQ ID NO: 4445 - DNA, 483 bp, Artificial; identical to SEQ ID NO: 3279
  TaSBEIIa-D allele with mutations introduced by TALEN pair TaSBEIIa_T03

SEQ ID NO: 4446 - DNA, 418 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgcaccggataaggcgcagcggtcgggctgaacgggggttcgggcgatctcgatcagctcgatgtacaaggtcctggtgcctgacggcgagagcgacgacttggcaagtccggcgc

SEQ ID NO: 4447 - DNA, 484 bp, Artificial; identical to SEQ ID NO: 3239
  TaSBEIIa-D allele with mutations introduced by TALEN pair TaSBEIIa_T03

SEQ ID NO: 4448 - DNA, 483 bp, Artificial; identical to SEQ ID NO: 3279
  TaSBEIIa-D allele with mutations introduced by TALEN pair TaSBEIIa_T03

SEQ ID NO: 4449 - DNA, 483 bp, Artificial; identical to SEQ ID NO: 3279
  TaSBEIIa-D allele with mutations introduced by TALEN pair TaSBEIIa_T03

SEQ ID NO: 4450 - DNA, 470 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4451 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcactttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4452 - DNA, 484 bp, Artificial; identical to SEQ ID NO: 3242
  TaSBEIIa-D allele with mutations introduced by TALEN pair TaSBEIIa_T03

SEQ ID NO: 4453 - DNA, 481 bp, Artificial; identical to SEQ ID NO: 3597
  TaSBEIIa-D allele with mutations introduced by TALEN pair TaSBEIIa_T03

SEQ ID NO: 4454 - DNA, 441 bp, Artificial; identical to SEQ ID NO: 3867
  TaSBEIIa-D allele with mutations introduced by TALEN pair TaSBEIIa_T03

SEQ ID NO: 4455 - DNA, 476 bp, Artificial
  TaSBEIIa-D allele with mutations introduced by TALEN pair TaSBEIIa_T03
gagatagctggattaggcgatcgcgcttcctgaacctgtattttttccccgcggggaatgcgttagtgtcacccaggccctggtgttaccacggctttgatcattcctcgtttcattctgatatatattttctcatctcttttcttccttgtcttgctgtactgcagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4456 - DNA, 573 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaaatgccgcaaaaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttc

SEQ ID NO: 4457 - DNA, 455 bp, Artificial; identical to SEQ ID NO: 3514
  TaSBEIIa-D allele with mutations introduced by TALEN pair TaSBEIIa_T03

SEQ ID NO: 4458 - DNA, 481 bp, Artificial; identical to SEQ ID NO: 3504
  TaSBEIIa-D allele with mutations introduced by TALEN pair TaSBEIIa_T03

SEQ ID NO: 4459 - DNA, 581 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagcgcctgcttgccgccatcgtggctggcgatggcccaccacctgctccggggtcaagccgtgggcctggcacagcaccggcaacagccgctgggatcttcacctagatccttttaaattaaaaatgaagttttaaatcaatctaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgcc

SEQ ID NO: 4460 - DNA, 527 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgttattcacttaccaaatgccgggatgaaaccaaccacggatgcgtcaggtttcgagcttcttctatcagcattgtgcagtactgcactgccttgttcattttgttagccttggccccgtgctggctc

SEQ ID NO: 4461 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatcctggtgcctgacggcgagagcgacgactttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4462 - DNA, 483 bp, Artificial; identical to SEQ ID NO: 3279
  TaSBEIIa-D allele with mutations introduced by TALEN pair TaSBEIIa_T03

SEQ ID NO: 4463 - DNA, 446 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcacctgaagaattacaggtacacacactcgtgccggtaaatcttctacaatcgttattcacttaccaaatgccggatgaaaccaaccacggatgcgtcaggtttcgagcttcttctatcagcattgtgcagtactgcactgccttgttcattttgttagccttggccccgtgctggctcttgggcca

SEQ ID NO: 4464 - DNA, 472 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4465 - DNA, 404 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattg

SEQ ID NO: 4466 - DNA, 456 bp, Artificial
  TaSBEIIa-D allele with mutations introduced by TALEN pair TaSBEIIa_T03
gagatagctggattaggcgatcgcgcttcctgaacctgtattttttcccgcggacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcaacctgaagaattacaggtacacacactcgtgccggtaaatcttcatacaatcgttattcacttaccaaatgccaggctgaaatccaaaccaacggatgcgtcaggttttcgagcttcttctatcagcattgtgcagtactgcactgccttgttcattttgttagccttggcccgcggctggctcttgggccactgaa

SEQ ID NO: 4467 - DNA, 453 bp, Artificial; identical to SEQ ID NO: 4002
  TaSBEIIa-D allele with mutations introduced by TALEN pair TaSBEIIa_T03

SEQ ID NO: 4468 - DNA, 484 bp, Artificial; identical to SEQ ID NO: 3242
  TaSBEIIa-D allele with mutations introduced by TALEN pair TaSBEIIa_T03

SEQ ID NO: 4469 - DNA, 464 bp, Artificial; identical to SEQ ID NO: 3902
  TaSBEIIa-D allele with mutations introduced by TALEN pair TaSBEIIa_T03

SEQ ID NO: 4470 - DNA, 573 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaacaggaaggcaaatgccgcaaaaagcaaggtcctggtgcctgacggcgagagcgacgacttggcaagtccggcgcaacctgaagaattacaggtacacacactcgtgccggtaaaatcttcatacaatcgttattcacttaccaaatgccggatgaaaccaaccacggatgcgtcaggtttcgagcttcttctatcagcattgtgcagtactgcactgccttgttca

SEQ ID NO: 4471 - DNA, 471 bp, Artificial; identical to SEQ ID NO: 4279
  TaSBEIIa-D allele with mutations introduced by TALEN pair TaSBEIIa_T03

SEQ ID NO: 4472 - DNA, 521 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtagctcttgatccggcaaacaaaccaccgcgccttgcagcacatccccctttcgccagctggcgtaatagcgaaaggtcctggtgcctgacggcgagagcgacgacttggcaagtccggcgcaacctgaagaattacaggtacacacactcgtgccggtaaatcttcatacaatcgttattcacttaccaaaatgccggatgaaaaccaaccacggatgcgtcaggttttcgagcttcttctatcagcattgtgcagtactgcactgccttgttca

SEQ ID NO: 4473 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcacttcttttcttctgtcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4474 - DNA, 483 bp, Artificial; identical to SEQ ID NO: 3279
  TaSBEIIa-D allele with mutations introduced by TALEN pair TaSBEIIa_T03

SEQ ID NO: 4475 - DNA, 457 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggc

SEQ ID NO: 4476 - DNA, 486 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4477 - DNA, 517 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaggccagcaaaaggccggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 4478 - DNA, 474 bp, Artificial; identical to SEQ ID NO: 4244
  TaSBEIIa-D allele with mutations introduced by TALEN pair TaSBEIIa_T03

SEQ ID NO: 4479 - DNA, 455 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 4480 - DNA, 479 bp, Artificial; identical to SEQ ID NO: 3326
  TaSBEIIa-D allele with mutations introduced by TALEN pair TaSBEIIa_T03

SEQ ID NO: 4481 - DNA, 483 bp, Artificial; identical to SEQ ID NO: 3363
  TaSBEIIa-D allele with mutations introduced by TALEN pair TaSBEIIa_T03

SEQ ID NO: 4482 - DNA, 437 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 4483 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggtcctggtgcctgagcggccgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4484 - DNA, 483 bp, Artificial; identical to SEQ ID NO: 3279
  TaSBEIIa-D allele with mutations introduced by TALEN pair TaSBEIIa_T03

SEQ ID NO: 4485 - DNA, 473 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4486 - DNA, 484 bp, Artificial; identical to SEQ ID NO: 3242
  TaSBEIIa-D allele with mutations introduced by TALEN pair TaSBEIIa_T03

SEQ ID NO: 4487 - DNA, 483 bp, Artificial; identical to SEQ ID NO: 3279
  TaSBEIIa-D allele with mutations introduced by TALEN pair TaSBEIIa_T03

SEQ ID NO: 4488 - DNA, 481 bp, Artificial; identical to SEQ ID NO: 4078
  TaSBEIIa-D allele with mutations introduced by TALEN pair TaSBEIIa_T03

SEQ ID NO: 4489 - DNA, 469 bp, Artificial; identical to SEQ ID NO: 3378
  TaSBEIIa-D allele with mutations introduced by TALEN pair TaSBEIIa_T03

SEQ ID NO: 4490 - DNA, 478 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4491 - DNA, 529 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggagccgcccaggtgcttgcccctgtagccgtacaccggcaacagccgctggaccgtctccagcgcctgcttgccaccattattgctgaaggtcctggtgcctgacggcgagagcgacgacttggcaagtccggcgcaacctgagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 4492 - DNA, 471 bp, Artificial; identical to SEQ ID NO: 4279
  TaSBEIIa-D allele with mutations introduced by TALEN pair TaSBEIIa_T03

SEQ ID NO: 4493 - DNA, 558 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggttgaaagcctcaacttgattcgcaacaaaagatccgctctgatactccgtgggaaggtcctggtgcctgacggcgagagcgacgacttggcaagtccgcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcatctgccttgttcattttgttagccttggccccgtgctggctcttgggccactgaa

SEQ ID NO: 4494 - DNA, 546 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgactggtgagtactcaaccaagtcattctgagaatagtcagcatgttcactacggaacaagtcggaataaagctaagaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctacagcattgtgcagtactgcactgccttgttcatttttgttagccttggccccgtg

SEQ ID NO: 4495 - DNA, 483 bp, Artificial; identical to SEQ ID NO: 3279
  TaSBEIIa-D allele with mutations introduced by TALEN pair TaSBEIIa_T03

SEQ ID NO: 4496 - DNA, 484 bp, Artificial; identical to SEQ ID NO: 3526
  TaSBEIIa-D allele with mutations introduced by TALEN pair TaSBEIIa_T03

SEQ ID NO: 4497 - DNA, 479 bp, Artificial; identical to SEQ ID NO: 3326
  TaSBEIIa-D allele with mutations introduced by TALEN pair TaSBEIIa_T03

SEQ ID NO: 4498 - DNA, 455 bp, Artificial; identical to SEQ ID NO: 4479
  TaSBEIIa-D allele with mutations introduced by TALEN pair TaSBEIIa_T03

SEQ ID NO: 4499 - DNA, 485 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4500 - DNA, 493 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtgactggaccgcgagcatgacggacgacgttggcaagttccggcagccaagccacttgaagaatttacaggtacacacactcgtgccggtaaatcttcatacaatcgttattcacttaccaaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 4501 - DNA, 480 bp, Artificial; identical to SEQ ID NO: 4011
  TaSBEIIa-D allele with mutations introduced by TALEN pair TaSBEIIa_T03

SEQ ID NO: 4502 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcactttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4503 - DNA, 579 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcaataatggtggcaagcaggcgctggagacggtccagcggctgttgccggtgctgtgccaggcccacggcttgaccccccagcaggtggtggcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4504 - DNA, 468 bp, Artificial; identical to SEQ ID NO: 3287
  TaSBEIIa-D allele with mutations introduced by TALEN pair TaSBEIIa_T03

SEQ ID NO: 4505 - DNA, 543 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaggccagcaaaaggccaggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 4506 - DNA, 471 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4507 - DNA, 484 bp, Artificial; identical to SEQ ID NO: 3240
  TaSBEIIa-D allele with mutations introduced by TALEN pair TaSBEIIa_T03

SEQ ID NO: 4508 - DNA, 486 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcactttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4509 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccatgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4510 - DNA, 522 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcccggagcaggtggtggccatcgccagccacgatggcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcatttttgttagccttggccccgtgctggctcttgggcca

SEQ ID NO: 4511 - DNA, 483 bp, Artificial; identical to SEQ ID NO: 3279
  TaSBEIIa-D allele with mutations introduced by TALEN pair TaSBEIIa_T03

SEQ ID NO: 4512 - DNA, 483 bp, Artificial; identical to SEQ ID NO: 3279
  TaSBEIIa-D allele with mutations introduced by TALEN pair TaSBEIIa_T03

SEQ ID NO: 4513 - DNA, 485 bp, Artificial; identical to SEQ ID NO: 3501
  TaSBEIIa-D allele with mutations introduced by TALEN pair TaSBEIIa_T03

SEQ ID NO: 4514 - DNA, 485 bp, Artificial; identical to SEQ ID NO: 4227
  TaSBEIIa-D allele with mutations introduced by TALEN pair TaSBEIIa_T03

SEQ ID NO: 4515 - DNA, 574 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggagccgcccaggtgcttgcccctgtagccgtacaccggcaacagccgctggaccgtctccagcgcctgcttgccaccattattgctgaaggtcctggtgccctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 4516 - DNA, 474 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccagtgagcctgactgcgcgagcgcgactgtagccagcgcacactgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4517 - DNA, 458 bp, Artificial
  TaSBEIIa-D allele with mutations introduced by TALEN pair TaSBEIIa_T03
gagatagctggattaggcgatcgcgcttcctgaacctgtattttttcccctggacgatgctgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccgaaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccc

SEQ ID NO: 4518 - DNA, 484 bp, Artificial; identical to SEQ ID NO: 3242
  TaSBEIIa-D allele with mutations introduced by TALEN pair TaSBEIIa_T03

SEQ ID NO: 4519 - DNA, 445 bp, Artificial
  TaSBEIIa-D allele with mutations introduced by TALEN pair TaSBEIIa_T03
gagatagctggattaggcgatcgcgcttcctgaacctgtattttttcccgctggaacgatgctgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctacagcattgtgcagtactgcactgccttgttcatttttgttagccttggcccc

SEQ ID NO: 4520 - DNA, 484 bp, Artificial; identical to SEQ ID NO: 3242
  TaSBEIIa-D allele with mutations introduced by TALEN pair TaSBEIIa_T03

SEQ ID NO: 4521 - DNA, 472 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4522 - DNA, 480 bp, Artificial; identical to SEQ ID NO: 3284
  TaSBEIIa-D allele with mutations introduced by TALEN pair TaSBEIIa_T03

SEQ ID NO: 4523 - DNA, 467 bp, Artificial; identical to SEQ ID NO: 3372
  TaSBEIIa-D allele with mutations introduced by TALEN pair TaSBEIIa_T03

SEQ ID NO: 4524 - DNA, 455 bp, Artificial; identical to SEQ ID NO: 3514
  TaSBEIIa-D allele with mutations introduced by TALEN pair TaSBEIIa_T03

SEQ ID NO: 4525 - DNA, 482 bp, Artificial; identical to SEQ ID NO: 3522
  TaSBEIIa-D allele with mutations introduced by TALEN pair TaSBEIIa_T03

SEQ ID NO: 4526 - DNA, 425 bp, Artificial; identical to SEQ ID NO: 4376
  TaSBEIIa-D allele with mutations introduced by TALEN pair TaSBEIIa_T03

SEQ ID NO: 4527 - DNA, 479 bp, Artificial; identical to SEQ ID NO: 4015
  TaSBEIIa-D allele with mutations introduced by TALEN pair TaSBEIIa_T03

SEQ ID NO: 4528 - DNA, 484 bp, Artificial; identical to SEQ ID NO: 3242
  TaSBEIIa-D allele with mutations introduced by TALEN pair TaSBEIIa_T03

SEQ ID NO: 4529 - DNA, 484 bp, Artificial; identical to SEQ ID NO: 3242
  TaSBEIIa-D allele with mutations introduced by TALEN pair TaSBEIIa_T03

SEQ ID NO: 4530 - DNA, 477 bp, Artificial; identical to SEQ ID NO: 3435
  TaSBEIIa-D allele with mutations introduced by TALEN pair TaSBEIIa_T03

SEQ ID NO: 4531 - DNA, 557 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcacgacggccagtgaattcgagctcggtacctcgcgaatgcatctagatccatgcttccggctcgtatgttgtgtggaggtcctggtgcctgacggcgagagcgacgacttggcaagtccggcgcaacctgaagaattacaggtacacacactcgtgccggtaaatcttcatacaatcgttattcacttaccaaaatgccggtgaaacaaccacggatgcgtcaggtttcgagcttcttctatcagcattgtgcagtactgcactgccttgttcattttgttagccttggccccgtgctggctcttgggccactgaa

SEQ ID NO: 4532 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4533 - DNA, 574 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaatccactcgtgcacccaactgatcttcagcatcttttactttcaccagcgtttctgggtgagcaaaaacaggaaggcaaaatgccgcaaaaagcaaggtcctggtgcctgacggcgagagcgacgacttggcaagtccggcgcaacctgaagaattacaggtacacacactcgtgccggtaaaatcttcatacaatcgttattcacttaccaaatgccggatgaaaccaaccacggatgcgtcaggtttcgagcttcttctatcagcattgtgcagtactgcactgccttgttc

SEQ ID NO: 4534 - DNA, 482 bp, Artificial; identical to SEQ ID NO: 3313
  TaSBEIIa-D allele with mutations introduced by TALEN pair TaSBEIIa_T03

SEQ ID NO: 4535 - DNA, 483 bp, Artificial; identical to SEQ ID NO: 3279
  TaSBEIIa-D allele with mutations introduced by TALEN pair TaSBEIIa_T03

SEQ ID NO: 4536 - DNA, 471 bp, Artificial; identical to SEQ ID NO: 3639
  TaSBEIIa-D allele with mutations introduced by TALEN pair TaSBEIIa_T03

SEQ ID NO: 4537 - DNA, 578 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcaataatggtggcaagcaggcgctggagacggtccagcggctgttgccggtgctgtgccaggcccacggcttgacccccagcaggtggtggcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4538 - DNA, 491 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtactggtcgctgactggcggagagcagacgacttgtcaggtccaggccgcaccactgaagaatttacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4539 - DNA, 454 bp, Artificial; identical to SEQ ID NO: 3774
  TaSBEIIa-D allele with mutations introduced by TALEN pair TaSBEIIa_T03

SEQ ID NO: 4540 - DNA, 480 bp, Artificial; identical to SEQ ID NO: 3859
  TaSBEIIa-D allele with mutations introduced by TALEN pair TaSBEIIa_T03

SEQ ID NO: 4541 - DNA, 526 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctggggaggtcctggtgcctgacggcgagagcgacgacttggcaagtccggcgcaacctgaagaattacaggtacacacactcgtgccggtaaatcttcatacaatcgttattcacttaccaaatgccggtgaaaccaaccacggatgcgtcaggtttcgagcttcttctatcagcattgtgcagtactgcactgccttgttcattttgttagccttggccccgtgctggctctt

SEQ ID NO: 4542 - DNA, 484 bp, Artificial; identical to SEQ ID NO: 3242
  TaSBEIIa-D allele with mutations introduced by TALEN pair TaSBEIIa_T03

SEQ ID NO: 4543 - DNA, 483 bp, Artificial; identical to SEQ ID NO: 3279
  TaSBEIIa-D allele with mutations introduced by TALEN pair TaSBEIIa_T03

SEQ ID NO: 4544 - DNA, 562 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtagctcttgatccggcaaacaaaccaccgcgccttgcagcacatccccctttcgccagctggcgtaatagcgaaaggtcctggtgcctgacggcgagagcgacgacttggcaagtccggcgcaacctgaagaattacaggtacacacactcgtgccggtaaatcttcatacaatcgttattcacttaccaaaatgccggatgaaaaccaaccacggatgcgtcaggtttcgagcttcttctatcagcattgtgcagtactgcactgccttgttcattttgttagccttggccccgtgctggctcttgggccactgaa

SEQ ID NO: 4545 - DNA, 484 bp, Artificial; identical to SEQ ID NO: 3242
  TaSBEIIa-D allele with mutations introduced by TALEN pair TaSBEIIa_T03

SEQ ID NO: 4546 - DNA, 471 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4547 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4548 - DNA, 491 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtactggtcgctggacggcggcagagcgacgacttgtcaggtccaggcggcaccactgaagaatttacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4549 - DNA, 526 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctggggaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4550 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaactcgttattctaccattaccaaagtgccggaatgaaccaaccacggatgcgtcaggtttcgagcttcttctatcagcattgtgcagtactgcactgccttgttcattttgttagccttggccccgtgctggctcttgggcca

SEQ ID NO: 4551 - DNA, 517 bp, Artificial; identical to SEQ ID NO: 4477
  TaSBEIIa-D allele with mutations introduced by TALEN pair TaSBEIIa_T03

SEQ ID NO: 4552 - DNA, 480 bp, Artificial; identical to SEQ ID NO: 3348
  TaSBEIIa-D allele with mutations introduced by TALEN pair TaSBEIIa_T03

SEQ ID NO: 4553 - DNA, 484 bp, Artificial; identical to SEQ ID NO: 3242
  TaSBEIIa-D allele with mutations introduced by TALEN pair TaSBEIIa_T03

SEQ ID NO: 4554 - DNA, 456 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggc

SEQ ID NO: 4555 - DNA, 482 bp, Artificial; identical to SEQ ID NO: 3522
  TaSBEIIa-D allele with mutations introduced by TALEN pair TaSBEIIa_T03

SEQ ID NO: 4556 - DNA, 469 bp, Artificial
  TaSBEIIa-D allele with mutations introduced by TALEN pair TaSBEIIa_T03
gagatagctggattaggcgatcgcgcttcctgaacctgtattttttccccgcggggaaactgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctgg

SEQ ID NO: 4557 - DNA, 484 bp, Artificial; identical to SEQ ID NO: 3242
  TaSBEIIa-D allele with mutations introduced by TALEN pair TaSBEIIa_T03

SEQ ID NO: 4558 - DNA, 565 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgactggtgagtactcaaccaagtcattctgagaatagtcagcatgttcactacggaacaagtcggaataaagctaagaaaaggtcctggtgcctgacggcgagagcgacgacttggcaagtccggcgcaacctgaagaattacaggtacacacactcgtgccggtaaatcttcatacaatcgttattcacttaccaaatgccggtgaaaccaaccacggatgcgtcaggtttcgagcttcttctatcagcattgtgcagtactgcactgccttgttcattttgttagccttggccccgtgctggctcttgggccactgaa

SEQ ID NO: 4559 - DNA, 469 bp, Artificial; identical to SEQ ID NO: 3787
  TaSBEIIa-D allele with mutations introduced by TALEN pair TaSBEIIa_T03

SEQ ID NO: 4560 - DNA, 482 bp, Artificial; identical to SEQ ID NO: 3313
  TaSBEIIa-D allele with mutations introduced by TALEN pair TaSBEIIa_T03

SEQ ID NO: 4561 - DNA, 510 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacgatgcgtcaggtttcgagcttcttctatcagcattgtgcagtactgcactgccttgttcattttgttagccttggccccgtgctggctcttgggccactgaactagactgccaaggcacacaggggata

SEQ ID NO: 4562 - DNA, 484 bp, Artificial; identical to SEQ ID NO: 3242
  TaSBEIIa-D allele with mutations introduced by TALEN pair TaSBEIIa_T03

SEQ ID NO: 4563 - DNA, 432 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 4564 - DNA, 557 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggttgaaagcctcaacttgattcgcaacaaaaagatccgctctgatactccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccgtgctggctcttgggccactgaa

SEQ ID NO: 4565 - DNA, 479 bp, Artificial; identical to SEQ ID NO: 3371
  TaSBEIIa-D allele with mutations introduced by TALEN pair TaSBEIIa_T03

SEQ ID NO: 4566 - DNA, 472 bp, Artificial; identical to SEQ ID NO: 4521
  TaSBEIIa-D allele with mutations introduced by TALEN pair TaSBEIIa_T03

SEQ ID NO: 4567 - DNA, 560 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtagctcttgatccggcaaacaaaccaccgcgccttgcagcacatccccctttcgccagctggcgtaatagcgaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4568 - DNA, 512 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattatcgcgcagaaaaaacaggaaggcaaaatgccgcaaaaaggggaaggtcctggtgcctgacggcgagagcgacgacttggcaagtccggcgcaacctgaagaattacaggtacacacactcgtgccggtaaatcttcatacaatcgttattcacttaccaaaatgccgggatgaaaccaaccacggatgcgtcaggtttcgagcttcttctatcagcattgtgcagtactgcactgccttg

SEQ ID NO: 4569 - DNA, 442 bp, Artificial; identical to SEQ ID NO: 3447
  TaSBEIIa-D allele with mutations introduced by TALEN pair TaSBEIIa_T03

SEQ ID NO: 4570 - DNA, 484 bp, Artificial; identical to SEQ ID NO: 3239
  TaSBEIIa-D allele with mutations introduced by TALEN pair TaSBEIIa_T03

SEQ ID NO: 4571 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggctgtttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4572 - DNA, 479 bp, Artificial; identical to SEQ ID NO: 3326
  TaSBEIIa-D allele with mutations introduced by TALEN pair TaSBEIIa_T03

SEQ ID NO: 4573 - DNA, 485 bp, Artificial; identical to SEQ ID NO: 3515
  TaSBEIIa-D allele with mutations introduced by TALEN pair TaSBEIIa_T03

SEQ ID NO: 4574 - DNA, 442 bp, Artificial; identical to SEQ ID NO: 3447
  TaSBEIIa-D allele with mutations introduced by TALEN pair TaSBEIIa_T03

SEQ ID NO: 4575 - DNA, 483 bp, Artificial; identical to SEQ ID NO: 3279
  TaSBEIIa-D allele with mutations introduced by TALEN pair TaSBEIIa_T03

SEQ ID NO: 4576 - DNA, 482 bp, Artificial; identical to SEQ ID NO: 3313
  TaSBEIIa-D allele with mutations introduced by TALEN pair TaSBEIIa_T03

SEQ ID NO: 4577 - DNA, 483 bp, Artificial; identical to SEQ ID NO: 3279
  TaSBEIIa-D allele with mutations introduced by TALEN pair TaSBEIIa_T03

SEQ ID NO: 4578 - DNA, 543 bp, Artificial; identical to SEQ ID NO: 3728
  TaSBEIIa-D allele with mutations introduced by TALEN pair TaSBEIIa_T03

SEQ ID NO: 4579 - DNA, 484 bp, Artificial; identical to SEQ ID NO: 3242
  TaSBEIIa-D allele with mutations introduced by TALEN pair TaSBEIIa_T03

SEQ ID NO: 4580 - DNA, 483 bp, Artificial; identical to SEQ ID NO: 3279
  TaSBEIIa-D allele with mutations introduced by TALEN pair TaSBEIIa_T03

SEQ ID NO: 4581 - DNA, 481 bp, Artificial; identical to SEQ ID NO: 3286
  TaSBEIIa-D allele with mutations introduced by TALEN pair TaSBEIIa_T03

SEQ ID NO: 4582 - DNA, 483 bp, Artificial; identical to SEQ ID NO: 3279
  TaSBEIIa-D allele with mutations introduced by TALEN pair TaSBEIIa_T03

SEQ ID NO: 4583 - DNA, 482 bp, Artificial; identical to SEQ ID NO: 3313
  TaSBEIIa-D allele with mutations introduced by TALEN pair TaSBEIIa_T03

SEQ ID NO: 4584 - DNA, 479 bp, Artificial; identical to SEQ ID NO: 3308
  TaSBEIIa-D allele with mutations introduced by TALEN pair TaSBEIIa_T03

SEQ ID NO: 4585 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccctggtgcctgacggcgagagcgacgactttggcaagtccggcgcaacctgaagaattacaggtacacacactcgtgccggtaaatcttcatacaatcgttattcactttaccaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 4586 - DNA, 456 bp, Artificial; identical to SEQ ID NO: 3581
  TaSBEIIa-D allele with mutations introduced by TALEN pair TaSBEIIa_T03

SEQ ID NO: 4587 - DNA, 468 bp, Artificial; identical to SEQ ID NO: 3775
  TaSBEIIa-D allele with mutations introduced by TALEN pair TaSBEIIa_T03

SEQ ID NO: 4588 - DNA, 449 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcacctgaagaattacaggtacacacactcgtgccggtaaatcttctacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 4589 - DNA, 483 bp, Artificial; identical to SEQ ID NO: 3279
  TaSBEIIa-D allele with mutations introduced by TALEN pair TaSBEIIa_T03

SEQ ID NO: 4590 - DNA, 467 bp, Artificial; identical to SEQ ID NO: 3534
  TaSBEIIa-D allele with mutations introduced by TALEN pair TaSBEIIa_T03

SEQ ID NO: 4591 - DNA, 484 bp, Artificial; identical to SEQ ID NO: 3242
  TaSBEIIa-D allele with mutations introduced by TALEN pair TaSBEIIa_T03

SEQ ID NO: 4592 - DNA, 557 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggttgaaagcctcaacttgattcgcaacaaaaagatccgctctgatactccgtgggaaggtcctggtgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4593 - DNA, 559 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggttgaaagcctcaacttgattcgcaacaaaaagaatccgctctgatactccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4594 - DNA, 483 bp, Artificial; identical to SEQ ID NO: 3469
  TaSBEIIa-D allele with mutations introduced by TALEN pair TaSBEIIa_T03

SEQ ID NO: 4595 - DNA, 477 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4596 - DNA, 415 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 4597 - DNA, 483 bp, Artificial; identical to SEQ ID NO: 3469
  TaSBEIIa-D allele with mutations introduced by TALEN pair TaSBEIIa_T03

SEQ ID NO: 4598 - DNA, 469 bp, Artificial; identical to SEQ ID NO: 3378
  TaSBEIIa-D allele with mutations introduced by TALEN pair TaSBEIIa_T03

SEQ ID NO: 4599 - DNA, 487 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaaggtcctggtgcctgacggcgagagcgacgactttggcaagtccggcgcaacctgaagaattacaggtacacacactcgtgccggtaaatcttcatacaatcgttattcacttaccaaatgcccggatgaaaccaaccacggatgcggtcaggtttcgagcttcttctatcagcattgtgcagtactgcactgccttgttcatttttgttagccttggccccgtgctggctcttgggccactgaa

SEQ ID NO: 4600 - DNA, 485 bp, Artificial; identical to SEQ ID NO: 3316
  TaSBEIIa-D allele with mutations introduced by TALEN pair TaSBEIIa_T03

SEQ ID NO: 4601 - DNA, 482 bp, Artificial; identical to SEQ ID NO: 4131
  TaSBEIIa-D allele with mutations introduced by TALEN pair TaSBEIIa_T03

SEQ ID NO: 4602 - DNA, 437 bp, Artificial
  TaSBEIIa-D allele with mutations introduced by TALEN pair TaSBEIIa_T03
gagatagctggattaggcgatcgcgcttcctgaacctgtattttttccccgcgggaacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccg

SEQ ID NO: 4603 - DNA, 477 bp, Artificial
  TaSBEIIa-D allele with mutations introduced by TALEN pair TaSBEIIa_T03
  misc_feature (412): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcggtgccggtaaatcttcatacaatcgttattcacttnccaaatgccggatgaaccaaccacggatgcgtcaggtttcgagctcttctatcagcattgtgcag

SEQ ID NO: 4604 - DNA, 494 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtactggtcgctgacggacggcagagcagacgacttggtcaaggtccaggcggcaaccactgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4605 - DNA, 627 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagcgcctgcttgccgccatcgtggctggcgatggcccaccacctgctccgggtcaagccgtgggcctggcacagcaccggcaacagccgctgggatcttcacctagatccttttaaattaaaaatgaagttttaaatcaatctaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactg

SEQ ID NO: 4606 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcactttaccaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 4607 - DNA, 484 bp, Artificial; identical to SEQ ID NO: 3242
  TaSBEIIa-D allele with mutations introduced by TALEN pair TaSBEIIa_T03

SEQ ID NO: 4608 - DNA, 483 bp, Artificial; identical to SEQ ID NO: 3279
  TaSBEIIa-D allele with mutations introduced by TALEN pair TaSBEIIa_T03

SEQ ID NO: 4609 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaatgttgtggttcgttttttcactattgtagtcatcctttgcattttgcaggcgccgtcctgagccgcgcggcctctccagtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4610 - DNA, 513 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaggccagcaaaaggccggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagcc

SEQ ID NO: 4611 - DNA, 468 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4612 - DNA, 484 bp, Artificial; identical to SEQ ID NO: 3242
  TaSBEIIa-D allele with mutations introduced by TALEN pair TaSBEIIa_T03

SEQ ID NO: 4613 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgcctgacggcgagagcgacgactttggcaagtccggcgcaacctgaagaattacaggtacacacactcgtgccggtaaatcttcatacaatcgttattcactttaccaaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4614 - DNA, 479 bp, Artificial; identical to SEQ ID NO: 3326
  TaSBEIIa-D allele with mutations introduced by TALEN pair TaSBEIIa_T03

SEQ ID NO: 4615 - DNA, 470 bp, Artificial; identical to SEQ ID NO: 3320
  TaSBEIIa-D allele with mutations introduced by TALEN pair TaSBEIIa_T03

SEQ ID NO: 4616 - DNA, 484 bp, Artificial; identical to SEQ ID NO: 3242
  TaSBEIIa-D allele with mutations introduced by TALEN pair TaSBEIIa_T03

SEQ ID NO: 4617 - DNA, 617 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagccccgacacccgccaacacccgctgaaggtcctggtgcctgacggcgagagcgacgacttggcaagtccggcgcaacctgaagaattacaggtacacacactcgtgccggtaaatccttcatacaatcgttattcacttaccaaattgccggaatgaaaccaaccacggatgcgtcaggtttcgagcttcttctatcagcattgtgcagtactgcactgccttgttcattttgttagccttggcccctgtgctggctcttgggccactgaa

SEQ ID NO: 4618 - DNA, 482 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4619 - DNA, 484 bp, Artificial; identical to SEQ ID NO: 3242
  TaSBEIIa-D allele with mutations introduced by TALEN pair TaSBEIIa_T03

SEQ ID NO: 4620 - DNA, 572 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagccccgacacccgcccaacacccgctgaaggtcctggtgcctgacggcgagagcgacgactttggcaagtccggcgcaacctgagaattacaggtacacacactcgtgccggtaaatcttcatacaatcgttattcacttaccaaattgccggaatgaaaccaaccacggatgcgtcaggtttcgagcttcttctatcagcattgtgcagtactgcactgccttgtt

SEQ ID NO: 4621 - DNA, 533 bp, Artificial; identical to SEQ ID NO: 4010
  TaSBEIIa-D allele with mutations introduced by TALEN pair TaSBEIIa_T03

SEQ ID NO: 4622 - DNA, 484 bp, Artificial; identical to SEQ ID NO: 3242
  TaSBEIIa-D allele with mutations introduced by TALEN pair TaSBEIIa_T03

SEQ ID NO: 4623 - DNA, 614 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagccccgacacccgccaacacccgctgaaggtcctggtgcctgacggcgagagcgacgacttggcaaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccgtgctggctcttgggccactgaa

SEQ ID NO: 4624 - DNA, 463 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgaaggtcctggtgcctgacggcgagagcgacgacttggcaagtccggcgcaacctgaagaattacaggtacacacactcgtgccggtaaatcttcatacaatccgttattcacttaccaaaatgccggatgaaaccaaccacggatgcgtcaggtttcgagcttcttctatcagcattgtgcagtacctgcactgccttgttcatttttgttagccttgg

SEQ ID NO: 4625 - DNA, 470 bp, Artificial; identical to SEQ ID NO: 3320
  TaSBEIIa-D allele with mutations introduced by TALEN pair TaSBEIIa_T03

SEQ ID NO: 4626 - DNA, 544 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatacgtttggaactgacagaaccgcaacgttgaaggagccactcagccgcgggtttctggagttaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttcattttgttagccttggccccgtgctggctcttgggccactg

SEQ ID NO: 4627 - DNA, 452 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 4628 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 4629 - DNA, 454 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggttttcgagcttcttctatcagcattgtgcagtactgcactgccttgttcatttttgttagccttggcccccgtgctgg

SEQ ID NO: 4630 - DNA, 505 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctggggaggtcctggtgcctgacggcgagagcgacgacttggcaagtccggcgcaacctgaagaattacaggtacacacactcgtgccggtaaatcttcatacaatcgttattcacttaccaatgccggatgaaaccaaccacggatgcgtcaggtttcgagcttcttctatcagcattgtgcagtactgcactgccttgttcattttgttagcc

SEQ ID NO: 4631 - DNA, 483 bp, Artificial; identical to SEQ ID NO: 3363
  TaSBEIIa-D allele with mutations introduced by TALEN pair TaSBEIIa_T03

SEQ ID NO: 4632 - DNA, 484 bp, Artificial; identical to SEQ ID NO: 3242
  TaSBEIIa-D allele with mutations introduced by TALEN pair TaSBEIIa_T03

SEQ ID NO: 4633 - DNA, 448 bp, Artificial
  TaSBEIIa-D allele with mutations introduced by TALEN pair TaSBEIIa_T03
  misc_feature (445): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaatcttcatacaatcgttattcacttaccaaaatgccggatgaaaccaaccacggatgcgtcaggttttcgagcttcttctacagcattgtgcagtactgcactgccttgttcattttgttagcttggcccccgngct

SEQ ID NO: 4634 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4635 - DNA, 476 bp, Artificial; identical to SEQ ID NO: 3568
  TaSBEIIa-D allele with mutations introduced by TALEN pair TaSBEIIa_T03

SEQ ID NO: 4636 - DNA, 566 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgactggtgagtactcaaccaagtcattctgagaatagtcagcatgttcactacggaacaagtcggaataaagctaagaaaaggtcctggtgcctgacggcgagagcgacgacttggcaagtccggcgcaacctgaagaattacaggtacacacactcgtgccggtaaatcttcatacaatcgttattcacttaccaaatgccggtgaaaccaaccacggatgcgtcaggtttcgagcttcttctatcagcattgtgcagtactgcactgccttgttcattttgttagccttggccccgtgctggctcttgggccactgaa

SEQ ID NO: 4637 - DNA, 406 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgc

SEQ ID NO: 4638 - DNA, 617 bp, Artificial; identical to SEQ ID NO: 3747
  TaSBEIIa-D allele with mutations introduced by TALEN pair TaSBEIIa_T03

SEQ ID NO: 4639 - DNA, 484 bp, Artificial; identical to SEQ ID NO: 3242
  TaSBEIIa-D allele with mutations introduced by TALEN pair TaSBEIIa_T03

SEQ ID NO: 4640 - DNA, 468 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactg

SEQ ID NO: 4641 - DNA, 614 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagccccgacacccgccaacacccgctgaaggtcctggtgcctgacggcgagagcgacgacttgggcaaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccgtgctggctcttgggccactgaa

SEQ ID NO: 4642 - DNA, 482 bp, Artificial; identical to SEQ ID NO: 3522
  TaSBEIIa-D allele with mutations introduced by TALEN pair TaSBEIIa_T03

SEQ ID NO: 4643 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccctggtgcctgacggcgagagcgacgacttggcaagtccggcgcaacctgaagaattacaggtacacacactcgtgccggtaaatcttcatacaatcgttatttcacttaccaaatatcggatgaaccaagccgcggaggcatcaggtttcaagcttcttctatcagcattgtgcactacttcactgccttgtgcagtttgttagctgtggccccgcgctggctcttgggccactgaa

SEQ ID NO: 4644 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4645 - DNA, 502 bp, Artificial; identical to SEQ ID NO: 4360
  TaSBEIIa-D allele with mutations introduced by TALEN pair TaSBEIIa_T03

SEQ ID NO: 4646 - DNA, 529 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattgcaggcgccgtcctgagccgcgcggcctctccagtgtacccctccagcgtgaccgagttcaagttcctgttcgtgtccggccacttcaagggcaaggtcctggtgcctgacggtgagagcgacgacttggcaagtccggcgcaacctgaagaattacaggtacacaccatcgtgccgggaaatcttcatacaatcgttattcacttaccaaaatgccggatgaaaccaagccgcggaggcgtcaggttttgagcttcttctatcagcattgtgcagtactgcactgccttgtgcattttgttagccgtggccccgtgctgg

SEQ ID NO: 4647 - DNA, 453 bp, Artificial
  TaSBEIIa-D allele with mutations introduced by TALEN pair TaSBEIIa_T03
  misc_feature (296): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgacggcgagagcgacgacttggcaagtccggcgcaacctgagaattacaggtncacacactcgtgccggtaaatcttcatacatcgttattcacttaccaaatgccggatgaaaccaaccacggatgcgtcaggtttcgagcttcttctatcagcattgtgcagtactgcactgccttgttcattttgttagccttggccccgtgctggc

SEQ ID NO: 4648 - DNA, 479 bp, Artificial; identical to SEQ ID NO: 3326
  TaSBEIIa-D allele with mutations introduced by TALEN pair TaSBEIIa_T03

SEQ ID NO: 4649 - DNA, 470 bp, Artificial; identical to SEQ ID NO: 3320
  TaSBEIIa-D allele with mutations introduced by TALEN pair TaSBEIIa_T03

SEQ ID NO: 4650 - DNA, 483 bp, Artificial; identical to SEQ ID NO: 3279
  TaSBEIIa-D allele with mutations introduced by TALEN pair TaSBEIIa_T03

SEQ ID NO: 4651 - DNA, 477 bp, Artificial; identical to SEQ ID NO: 3435
  TaSBEIIa-D allele with mutations introduced by TALEN pair TaSBEIIa_T03

SEQ ID NO: 4652 - DNA, 483 bp, Artificial; identical to SEQ ID NO: 3279
  TaSBEIIa-D allele with mutations introduced by TALEN pair TaSBEIIa_T03

SEQ ID NO: 4653 - DNA, 479 bp, Artificial; identical to SEQ ID NO: 3326
  TaSBEIIa-D allele with mutations introduced by TALEN pair TaSBEIIa_T03

SEQ ID NO: 4654 - DNA, 608 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaatgccgcaaaaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtttagccttggccccgtgctggctcttggg

SEQ ID NO: 4655 - DNA, 469 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4656 - DNA, 579 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagacggtgcaggcgctgttgccggtgctgtgccaggcccacggctttgaccccggagcaggtggtggccatcgccagccacgatggcggcaagcaaggtcctggtgcctgacggcgagagcgacgacttggcaagtccggcgcaacctgagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4657 - DNA, 524 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaggccagcaaaaggccggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 4658 - DNA, 484 bp, Artificial; identical to SEQ ID NO: 3242
  TaSBEIIa-D allele with mutations introduced by TALEN pair TaSBEIIa_T03

SEQ ID NO: 4659 - DNA, 479 bp, Artificial; identical to SEQ ID NO: 3428
  TaSBEIIa-D allele with mutations introduced by TALEN pair TaSBEIIa_T03

SEQ ID NO: 4660 - DNA, 520 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcccggagcaggtggtggccatcgccagccacgatggcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacgggatgcgtcaggttttcgagcttcttctatcagcattgtgcagtactgcactgccttgttcatttttgttagccttggccccgtgctggctcttggg

SEQ ID NO: 4661 - DNA, 429 bp, Artificial
  TaSBEIIa-D allele with mutations introduced by TALEN pair TaSBEIIa_T03
gagatagctggattaggcgatcgcgcttcctgaacctgtattttttcccgcggacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcacctgaagaattacaggtacacacactcgtgccggtaaatcttcatacaatcgttattcacttaccaaatgccggatgaaaccaaccacggatgcgtcaggtttcgagcttcattctatcagcattgtgcagtactgcactgccttgttcattttgttagccttggcccgc

SEQ ID NO: 4662 - DNA, 484 bp, Artificial; identical to SEQ ID NO: 3242
  TaSBEIIa-D allele with mutations introduced by TALEN pair TaSBEIIa_T03

SEQ ID NO: 4663 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttctgctgtaactgcaagttgtggcgttttttcactattgtagtcatccttgcattttgcaggcgccgtcctgagccgcgcggcctctccaggtcctggtgtctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4664 - DNA, 577 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagcgcctgcttgccgccatcgtggctggcgatggccaccacctgctccgggtcaagccgtgggcctggcacagcaccggcaacagccgctgggatcttcacctagatccttttaaattaaaatgaagttttaaatcaatctaaggtcctggtgcctgacggcgagagcgacgacttggcagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgcc

SEQ ID NO: 4665 - DNA, 481 bp, Artificial; identical to SEQ ID NO: 3336
  TaSBEIIa-D allele with mutations introduced by TALEN pair TaSBEIIa_T03

SEQ ID NO: 4666 - DNA, 483 bp, Artificial; identical to SEQ ID NO: 3279
  TaSBEIIa-D allele with mutations introduced by TALEN pair TaSBEIIa_T03

SEQ ID NO: 4667 - DNA, 469 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttacaggcgccgtcctgagccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4668 - DNA, 485 bp, Artificial; identical to SEQ ID NO: 4499
  TaSBEIIa-D allele with mutations introduced by TALEN pair TaSBEIIa_T03

SEQ ID NO: 4669 - DNA, 483 bp, Artificial; identical to SEQ ID NO: 3279
  TaSBEIIa-D allele with mutations introduced by TALEN pair TaSBEIIa_T03

SEQ ID NO: 4670 - DNA, 469 bp, Artificial; identical to SEQ ID NO: 3440
  TaSBEIIa-D allele with mutations introduced by TALEN pair TaSBEIIa_T03

SEQ ID NO: 4671 - DNA, 485 bp, Artificial; identical to SEQ ID NO: 3515
  TaSBEIIa-D allele with mutations introduced by TALEN pair TaSBEIIa_T03

SEQ ID NO: 4672 - DNA, 484 bp, Artificial; identical to SEQ ID NO: 3242
  TaSBEIIa-D allele with mutations introduced by TALEN pair TaSBEIIa_T03

SEQ ID NO: 4673 - DNA, 546 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccatacgtttggaactgacagaaccgcaacgttgaaggagccactcagccgcggggtttctggagttaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 4674 - DNA, 484 bp, Artificial; identical to SEQ ID NO: 3239
  TaSBEIIa-D allele with mutations introduced by TALEN pair TaSBEIIa_T03

SEQ ID NO: 4675 - DNA, 510 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagccagcagcaacaggagaagatcaaaccgaaggtcctggtgcctgacggcgagagcgacgacttggcaagtccggcgcacctgaagaattacaggtacacacactcgtgccggtaatcattcatacaatcgttattcacttaccaaatgccggatgaaaccaaccacggatgcgtcaggttttcgagcttcttctatcagcattgtgcagtactgcactgccttgttcatttttgttagccttggccccgtgctggctcttgggcca

SEQ ID NO: 4676 - DNA, 469 bp, Artificial; identical to SEQ ID NO: 3378
  TaSBEIIa-D allele with mutations introduced by TALEN pair TaSBEIIa_T03

SEQ ID NO: 4677 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccaaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4678 - DNA, 614 bp, Artificial
  TaSBEIIa-D allele with mutations introduced by TALEN pair TaSBEIIa_T03
  misc_feature (362): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgcgcaaactaggataaattatcgcgccgcgatagaaaacaaaatatgcgcgcaaactaggataaattatcgctgctctgatgccgcatagttaagccagccccgacacccgccaanacccgctgaaggtcctggtgcctgacggcgagagcgacgacttgggcaaagtccggcgcaacctgaagaattacaggtacacacactcgtgccgggtaaatcttcatacaatcgttattcacttaccaaatgccggatgaaaccaaccacggatgcgtcaggtttcgagcttcttctatcagcattgtgcagtactgcactgccttgttcattttgttagccttggcccgtgctggctcttgggccactgaa

SEQ ID NO: 4679 - DNA, 478 bp, Artificial; identical to SEQ ID NO: 3395
  TaSBEIIa-D allele with mutations introduced by TALEN pair TaSBEIIa_T03

SEQ ID NO: 4680 - DNA, 483 bp, Artificial; identical to SEQ ID NO: 3279
  TaSBEIIa-D allele with mutations introduced by TALEN pair TaSBEIIa_T03

SEQ ID NO: 4681 - DNA, 452 bp, Artificial; identical to SEQ ID NO: 4627
  TaSBEIIa-D allele with mutations introduced by TALEN pair TaSBEIIa_T03

SEQ ID NO: 4682 - DNA, 469 bp, Artificial; identical to SEQ ID NO: 3787
  TaSBEIIa-D allele with mutations introduced by TALEN pair TaSBEIIa_T03

SEQ ID NO: 4683 - DNA, 487 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgactttggcaagtccggcgcaacctgaagaattacaggtacacacactcgtgccggtaaatcttcatacaatcgttattcacttaccaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 4684 - DNA, 483 bp, Artificial; identical to SEQ ID NO: 3279
  TaSBEIIa-D allele with mutations introduced by TALEN pair TaSBEIIa_T03

SEQ ID NO: 4685 - DNA, 470 bp, Artificial; identical to SEQ ID NO: 4256
  TaSBEIIa-D allele with mutations introduced by TALEN pair TaSBEIIa_T03

SEQ ID NO: 4686 - DNA, 482 bp, Artificial; identical to SEQ ID NO: 3313
  TaSBEIIa-D allele with mutations introduced by TALEN pair TaSBEIIa_T03

SEQ ID NO: 4687 - DNA, 484 bp, Artificial; identical to SEQ ID NO: 3242
  TaSBEIIa-D allele with mutations introduced by TALEN pair TaSBEIIa_T03

SEQ ID NO: 4688 - DNA, 467 bp, Artificial; identical to SEQ ID NO: 3372
  TaSBEIIa-D allele with mutations introduced by TALEN pair TaSBEIIa_T03

SEQ ID NO: 4689 - DNA, 526 bp, Artificial; identical to SEQ ID NO: 4549
  TaSBEIIa-D allele with mutations introduced by TALEN pair TaSBEIIa_T03

SEQ ID NO: 4690 - DNA, 413 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaatcttcatacaatcgttattcacttaccaaatgccggatgaaaccaaccacggatgcgtcaggtttcgagcttcttctacagcattgtgcagtactgcactgccttgttca

SEQ ID NO: 4691 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcatgcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4692 - DNA, 484 bp, Artificial; identical to SEQ ID NO: 3242
  TaSBEIIa-D allele with mutations introduced by TALEN pair TaSBEIIa_T03

SEQ ID NO: 4693 - DNA, 543 bp, Artificial; identical to SEQ ID NO: 4505
  TaSBEIIa-D allele with mutations introduced by TALEN pair TaSBEIIa_T03

SEQ ID NO: 4694 - DNA, 479 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttttgcaggcgccgtcctgagccgcgcggcctctgtgcctgacggcgagagcgacgacttggcaagtccggcgcaacctgaagaattacaggtacacacactcgtgccggtaaatcttcatacaatcgttattcactttaccaaaatgccggatgaaaccaaccacggatgcgtcaggtttcgagctttcttctatcagcattgtgcagtactgcactgccttgttcatttttgttagccttggccccgtgctggctcttgggccactgaa

SEQ ID NO: 4695 - DNA, 455 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagcattgtgcagtactgcactgccttgttcattttgttagccttggccccgtgctggc

SEQ ID NO: 4696 - DNA, 451 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgcaccggataaggcgcagcggtcggctgaacgggggttcggcgatctcgatcagctcgatgtacaaggtcctggtgcctgacggcgagagcgacgacttggcaagtccggcgcaacctgaagaattgacaggtacacacactcgtgcc

SEQ ID NO: 4697 - DNA, 479 bp, Artificial; identical to SEQ ID NO: 3308
  TaSBEIIa-D allele with mutations introduced by TALEN pair TaSBEIIa_T03

SEQ ID NO: 4698 - DNA, 484 bp, Artificial; identical to SEQ ID NO: 3526
  TaSBEIIa-D allele with mutations introduced by TALEN pair TaSBEIIa_T03

SEQ ID NO: 4699 - DNA, 484 bp, Artificial; identical to SEQ ID NO: 3242
  TaSBEIIa-D allele with mutations introduced by TALEN pair TaSBEIIa_T03

SEQ ID NO: 4700 - DNA, 485 bp, Artificial; identical to SEQ ID NO: 3515
  TaSBEIIa-D allele with mutations introduced by TALEN pair TaSBEIIa_T03

SEQ ID NO: 4701 - DNA, 543 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattgcaggcgccgtcctgagccgcgcggcctctccagtgtacccctccagcgtgaccgagttcaagttcctgttcgtgtccggccacttcaagggcaaggtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcattttgttagccgtggccccgtgctggctcttgggccactg

SEQ ID NO: 4702 - DNA, 485 bp, Artificial; identical to SEQ ID NO: 4227
  TaSBEIIa-D allele with mutations introduced by TALEN pair TaSBEIIa_T03

SEQ ID NO: 4703 - DNA, 491 bp, Artificial
  TaSBEIIa-D allele with mutations introduced by TALEN pair TaSBEIIa_T03
  misc_feature (410): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaaggtcctggtgcctgacggcgagagcgacgacttggcaagtccggcgcaacctgaagaattacaggtacacacactcgtgccggtaaatcttcatacaatcgttatcacttnccaaatgccggatgaaaccaaccacggatgcgtcaggtttcgagctcttctatcagcattgtgcagtactgcactgccttg

SEQ ID NO: 4704 - DNA, 476 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggccgtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4705 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctaggtcctggtgcctgacggcgagagcgacgactttggcaagtccggcgcaacctgaagaattacaggtacacacactcgtgccggtaaatcttcatacaatcgttattcactttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4706 - DNA, 468 bp, Artificial; identical to SEQ ID NO: 4117
  TaSBEIIa-D allele with mutations introduced by TALEN pair TaSBEIIa_T03

SEQ ID NO: 4707 - DNA, 479 bp, Artificial; identical to SEQ ID NO: 3308
  TaSBEIIa-D allele with mutations introduced by TALEN pair TaSBEIIa_T03

SEQ ID NO: 4708 - DNA, 484 bp, Artificial; identical to SEQ ID NO: 3239
  TaSBEIIa-D allele with mutations introduced by TALEN pair TaSBEIIa_T03

SEQ ID NO: 4709 - DNA, 485 bp, Artificial; identical to SEQ ID NO: 4298
  TaSBEIIa-D allele with mutations introduced by TALEN pair TaSBEIIa_T03

SEQ ID NO: 4710 - DNA, 483 bp, Artificial; identical to SEQ ID NO: 3279
  TaSBEIIa-D allele with mutations introduced by TALEN pair TaSBEIIa_T03

SEQ ID NO: 4711 - DNA, 582 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagacggtgcaggcgctgttgccggtgctgtgccaggcccacggctttgacccccggagcaggtggtggccatcgccagccacgatggcggcaagcaaggtcctggtgcctgacggcgagagcgacgacttggcaagtccggcgcaacctgaagaattacagggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4712 - DNA, 527 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctggggaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4713 - DNA, 477 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4714 - DNA, 484 bp, Artificial; identical to SEQ ID NO: 3526
  TaSBEIIa-D allele with mutations introduced by TALEN pair TaSBEIIa_T03

SEQ ID NO: 4715 - DNA, 581 bp, Artificial
  TaSBEIIa-D allele with mutations introduced by TALEN pair TaSBEIIa_T03
  misc_feature (504): n is a or c or t or g
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcaataatggtggcaagcaggcgctggagacggtccagcggctgttgccggtgctgtgccaggcccacggcttgaccccccagcaggtggtggcaaggtcctggtgcctgacggcgagagcgacgacttggcaagtccggcgcaacctgagaattacaggtacacacactcgtgccggtaaatcttcatacaatcgttattcacttaccaaatgccggatgaaaccaaccacggatgcgtcgaggtttcgagcttcttcnatcagcattgtgcagtactgcactgccttgttcatttttgttagccttggccccgtgctggctcttgggccactgaa

SEQ ID NO: 4716 - DNA, 479 bp, Artificial; identical to SEQ ID NO: 3326
  TaSBEIIa-D allele with mutations introduced by TALEN pair TaSBEIIa_T03

SEQ ID NO: 4717 - DNA, 485 bp, Artificial; identical to SEQ ID NO: 3515
  TaSBEIIa-D allele with mutations introduced by TALEN pair TaSBEIIa_T03

SEQ ID NO: 4718 - DNA, 472 bp, Artificial
  TaSBEIIa-D allele with mutations introduced by TALEN pair TaSBEIIa_T03
gagatagctggattaggcgatcgcgcttcctgaacctgtatttttccccgcggggaatgcgttagtgtcacccaggccctggtgttaccacggctttgatcattcctcgtttcattctgatatatattttctcactctttttcttcctgttcttgctgtaactgcaagttgtggcgtttttcactattgtagtcatccttgcattttgcaggcgccgtcctgagccgcgcggcctctccggagccgcccaggtgcttgccctgtagccgtacaccggcacagccgctggaccgtctccagcgcctgcttgccaccattattgctgaaggtcctggtgcctgacggcgagagcgacgacttggcaagtccggcgcaacctgagaattacaggtacacacactcgtgccggtaaatcttcataccaatcgttattcacttaccaaatgccggatgaaaccaaccacggatgcgc

SEQ ID NO: 4719 - DNA, 456 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcctgacggcgagagcgacgacttggcaagtccggcgcaacctgaagaattacaggtacacacactcgtgtcggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggc

SEQ ID NO: 4720 - DNA, 629 bp, Artificial; identical to SEQ ID NO: 4012
  TaSBEIIa-D allele with mutations introduced by TALEN pair TaSBEIIa_T03

SEQ ID NO: 4721 - DNA, 483 bp, Artificial; identical to SEQ ID NO: 3279
  TaSBEIIa-D allele with mutations introduced by TALEN pair TaSBEIIa_T03

SEQ ID NO: 4722 - DNA, 530 bp, Artificial
  TaSBEIIa-D allele with mutations introduced by TALEN pair TaSBEIIa_T03
  misc_feature (269): n is a or c or t or g
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaaggccngcaaaaaggcccggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgcccttgttcattttgttagccttggccccgtgcgg

SEQ ID NO: 4723 - DNA, 484 bp, Artificial; identical to SEQ ID NO: 4383
  TaSBEIIa-D allele with mutations introduced by TALEN pair TaSBEIIa_T03

SEQ ID NO: 4724 - DNA, 470 bp, Artificial; identical to SEQ ID NO: 3580
  TaSBEIIa-D allele with mutations introduced by TALEN pair TaSBEIIa_T03

SEQ ID NO: 4725 - DNA, 484 bp, Artificial; identical to SEQ ID NO: 3242
  TaSBEIIa-D allele with mutations introduced by TALEN pair TaSBEIIa_T03

SEQ ID NO: 4726 - DNA, 484 bp, Artificial; identical to SEQ ID NO: 3239
  TaSBEIIa-D allele with mutations introduced by TALEN pair TaSBEIIa_T03

SEQ ID NO: 4727 - DNA, 470 bp, Artificial; identical to SEQ ID NO: 3580
  TaSBEIIa-D allele with mutations introduced by TALEN pair TaSBEIIa_T03

SEQ ID NO: 4728 - DNA, 575 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaaatgccgcaaaaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 4729 - DNA, 484 bp, Artificial; identical to SEQ ID NO: 3242
  TaSBEIIa-D allele with mutations introduced by TALEN pair TaSBEIIa_T03

SEQ ID NO: 4730 - DNA, 455 bp, Artificial
  TaSBEIIa-D allele with mutations introduced by TALEN pair TaSBEIIa_T03
gagatagctggattaggcgatcgcgcttcctgaacctgtattttttccccgcgggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagcctt

SEQ ID NO: 4731 - DNA, 479 bp, Artificial; identical to SEQ ID NO: 3326
  TaSBEIIa-D allele with mutations introduced by TALEN pair TaSBEIIa_T03

SEQ ID NO: 4732 - DNA, 454 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccccgtgctggtcttgggccact

SEQ ID NO: 4733 - DNA, 455 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactactttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggcccccgtgctggtc

SEQ ID NO: 4734 - DNA, 484 bp, Artificial; identical to SEQ ID NO: 3242
  TaSBEIIa-D allele with mutations introduced by TALEN pair TaSBEIIa_T03

SEQ ID NO: 4735 - DNA, 472 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4736 - DNA, 503 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagccagcagcaacaggagaagatcaaaccgaaggtcctggtgcctgacggcgagagcgacgacttggcaagtccggcgcacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctctt

SEQ ID NO: 4737 - DNA, 455 bp, Artificial; identical to SEQ ID NO: 4695
  TaSBEIIa-D allele with mutations introduced by TALEN pair TaSBEIIa_T03

SEQ ID NO: 4738 - DNA, 484 bp, Artificial; identical to SEQ ID NO: 3211
  TaSBEIIa-D allele with mutations introduced by TALEN pair TaSBEIIa_T03

SEQ ID NO: 4739 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4740 - DNA, 479 bp, Artificial; identical to SEQ ID NO: 3308
  TaSBEIIa-D allele with mutations introduced by TALEN pair TaSBEIIa_T03

SEQ ID NO: 4741 - DNA, 477 bp, Artificial
  TaSBEIIa-D allele with mutations introduced by TALEN pair TaSBEIIa_T03
  misc_feature (453): n is a or c or t or g
gagatagctggattaggcgatcgcgcttcctgaacctgtattttttcccgcggacggatgctgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccncgtgctggctcttgggccactgaa

SEQ ID NO: 4742 - DNA, 482 bp, Artificial; identical to SEQ ID NO: 3278
  TaSBEIIa-D allele with mutations introduced by TALEN pair TaSBEIIa_T03

SEQ ID NO: 4743 - DNA, 567 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgactggtgagtactcaaccaagtcattctgagaatagtcagcatgttcactacggaacaagtcggaataaagctaagaaaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 4744 - DNA, 492 bp, Artificial
  TaSBEIIa-D allele with mutations introduced by TALEN pair TaSBEIIa_T03
  misc_feature (410): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtgcgttttttcactattgtagtcatccttgcattttgcaggcgccgtcctgagccgcgcggcctctccagaaaccattattgcgcgttcaaaagtcgcctaccgcacagatgcgtaaggagaaaaggtcctggtgcctgacggcgagagcgacgacttggcaagtccggcgcaacctgaagaattacaggtacacacactcgtgccggtaaatcttcatacaatcgttattcacttnccaaatgccggatgaaaccaaccacggatgcgtcaggtttcgagcttcttctatcagcattgtgcagtactgcactgccttg

SEQ ID NO: 4745 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtcgctggctcttgggccactgaa

SEQ ID NO: 4746 - DNA, 435 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggttttcgagcttcttctacagcattgtgcagtactgcactgccttgttcatttttgttag

SEQ ID NO: 4747 - DNA, 484 bp, Artificial; identical to SEQ ID NO: 3242
  TaSBEIIa-D allele with mutations introduced by TALEN pair TaSBEIIa_T03

SEQ ID NO: 4748 - DNA, 511 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattacgcgcagaaaaaacaggaaggcaaaatgccgcaaaaaaggggaaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttg

SEQ ID NO: 4749 - DNA, 481 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaatgttgtggttcgttttttcactattgtagtcatcctttgcattttgcaggcgccgtcctgagccgcgcggcctctccagtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4750 - DNA, 480 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4751 - DNA, 525 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttggccccgtgctggctc

SEQ ID NO: 4752 - DNA, 479 bp, Artificial; identical to SEQ ID NO: 3371
  TaSBEIIa-D allele with mutations introduced by TALEN pair TaSBEIIa_T03

SEQ ID NO: 4753 - DNA, 560 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtagctcttgatccggcaaacaaaccaccgcgccttgcagcacatccccctttcgccagctggcgtaatagcgaaaggtcctggtgcctgacggcgagagcgacgacttggcaagtccggcgcaacctgaagaattacaggtacacacactcgtgccggtaaatcttcatacaatcgttattcacttaccaaatgccggtgaaaccaaccacggatgcgtcaggtttcgagcttcttctatcagcattgtgcagtactgcactgccttgttcatttttgttagccttggccccgtgctggctcttgggccactgaa

SEQ ID NO: 4754 - DNA, 474 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccccgtgctggctctt

SEQ ID NO: 4755 - DNA, 572 bp, Artificial; identical to SEQ ID NO: 3798
  TaSBEIIa-D allele with mutations introduced by TALEN pair TaSBEIIa_T03

SEQ ID NO: 4756 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4757 - DNA, 471 bp, Artificial; identical to SEQ ID NO: 4279
  TaSBEIIa-D allele with mutations introduced by TALEN pair TaSBEIIa_T03

SEQ ID NO: 4758 - DNA, 487 bp, Artificial
  TaSBEIIa-D allele with mutations introduced by TALEN pair TaSBEIIa_T03
gagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4759 - DNA, 479 bp, Artificial; identical to SEQ ID NO: 3428
  TaSBEIIa-D allele with mutations introduced by TALEN pair TaSBEIIa_T03

SEQ ID NO: 4760 - DNA, 561 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtagctcttgatccggcaaacaaaccaccgcgccttgcagcacatccccctttcgccagctggcgtaatagcgaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4761 - DNA, 484 bp, Artificial; identical to SEQ ID NO: 3242
  TaSBEIIa-D allele with mutations introduced by TALEN pair TaSBEIIa_T03

SEQ ID NO: 4762 - DNA, 470 bp, Artificial; identical to SEQ ID NO: 3580
  TaSBEIIa-D allele with mutations introduced by TALEN pair TaSBEIIa_T03

SEQ ID NO: 4763 - DNA, 476 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttccgatgtaatccactcgtgcacccaactgatcttcagcatcttttactttcaccagcgtttctgggtgagcaaaaacaggaaggcaaatgccgcaaaaagcaaggtcctggtgcctgacggcgagagcgacgacttggcaagtccggcgcaacctgaagaattacaggtacaccacactcgtgccggtaaatcttcatacaat

SEQ ID NO: 4764 - DNA, 483 bp, Artificial; identical to SEQ ID NO: 3279
  TaSBEIIa-D allele with mutations introduced by TALEN pair TaSBEIIa_T03

SEQ ID NO: 4765 - DNA, 581 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagcgcctgcttgccgccatcgtggctggcgatggccaccacctgctccggggtcaagccgtgggcctggcacagcaccggcaacagccgctgggatcttcacctagatccttttaaattaaaaatgaagttttaaatcaatctaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggattgcgtcaggttttcgagcttcttctatcagcattgtgcagtactgcactgcc

SEQ ID NO: 4766 - DNA, 483 bp, Artificial; identical to SEQ ID NO: 3279
  TaSBEIIa-D allele with mutations introduced by TALEN pair TaSBEIIa_T03

SEQ ID NO: 4767 - DNA, 422 bp, Artificial
  TaSBEIIa-D allele with mutations introduced by TALEN pair TaSBEIIa_T03
gagatagctggattaggcgatcgcgccttcctgaacctgtattttttccccgcggggaaatgctgttagtgtcacccaggcccctggtgttaccatcggctttgatcattcctcgtttcattctgatatatattttctcactctttttcttccgttctttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacatcgttattcacttacccaaatgccggatgaaaccaaccacggatgcgtcaggtttcgagcttcttctgatcagcattgtgcagtactgcactgc

SEQ ID NO: 4768 - DNA, 484 bp, Artificial; identical to SEQ ID NO: 3242
  TaSBEIIa-D allele with mutations introduced by TALEN pair TaSBEIIa_T03

SEQ ID NO: 4769 - DNA, 487 bp, Artificial
  TaSBEIIa-D allele with mutations introduced by TALEN pair TaSBEIIa_T03
  misc_feature (411): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgttattcacttnccaaatgccggatgaaaccaaccacggatgcgtcaggtttcgagctcttctatcagcattgtgcagtactgcactg

SEQ ID NO: 4770 - DNA, 448 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatactaatttttctcactgcttttttcttccatgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 4771 - DNA, 468 bp, Artificial; identical to SEQ ID NO: 4093
  TaSBEIIa-D allele with mutations introduced by TALEN pair TaSBEIIa_T03

SEQ ID NO: 4772 - DNA, 479 bp, Artificial; identical to SEQ ID NO: 4628
  TaSBEIIa-D allele with mutations introduced by TALEN pair TaSBEIIa_T03

SEQ ID NO: 4773 - DNA, 473 bp, Artificial
  TaSBEIIa-D allele with mutations introduced by TALEN pair TaSBEIIa_T03
gagatagctggattaggcgatcgcgcttcctgaacctgtattttttccccgcggggaaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4774 - DNA, 481 bp, Artificial; identical to SEQ ID NO: 3504
  TaSBEIIa-D allele with mutations introduced by TALEN pair TaSBEIIa_T03

SEQ ID NO: 4775 - DNA, 545 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattatcgcgcagaaaaaacaggaaggcaaaatgccgcaaaaaaggggaaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctc

SEQ ID NO: 4776 - DNA, 451 bp, Artificial; identical to SEQ ID NO: 3761
  TaSBEIIa-D allele with mutations introduced by TALEN pair TaSBEIIa_T03

SEQ ID NO: 4777 - DNA, 557 bp, Artificial; identical to SEQ ID NO: 4564
  TaSBEIIa-D allele with mutations introduced by TALEN pair TaSBEIIa_T03

SEQ ID NO: 4778 - DNA, 470 bp, Artificial
  TaSBEIIa-D allele with mutations introduced by TALEN pair TaSBEIIa_T03
  misc_feature (261): n is a or c or t or g
gagatagctggattaggcgatcgcgcttcctgaacctgtatttttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtgcctgcggcgagagcgacgncttggcaagtccggcgcaacctgaagaatttcaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactg

SEQ ID NO: 4779 - DNA, 530 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattatcgcgcagaaaaaacaggaaggcaaaatgccgcaaaaaaggggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtagccttgg

SEQ ID NO: 4780 - DNA, 483 bp, Artificial; identical to SEQ ID NO: 3279
  TaSBEIIa-D allele with mutations introduced by TALEN pair TaSBEIIa_T03

SEQ ID NO: 4781 - DNA, 484 bp, Artificial; identical to SEQ ID NO: 3242
  TaSBEIIa-D allele with mutations introduced by TALEN pair TaSBEIIa_T03

SEQ ID NO: 4782 - DNA, 483 bp, Artificial; identical to SEQ ID NO: 3279
  TaSBEIIa-D allele with mutations introduced by TALEN pair TaSBEIIa_T03

SEQ ID NO: 4783 - DNA, 467 bp, Artificial; identical to SEQ ID NO: 3372
  TaSBEIIa-D allele with mutations introduced by TALEN pair TaSBEIIa_T03

SEQ ID NO: 4784 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccccgtgctggctcttgggccactgaa

SEQ ID NO: 4785 - DNA, 452 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcctgacggcgagagcgacgacttggcaagtccggcgcaacctgaagaattacaggtacacacactcgtgtcggtaaatcttcatacaatcgttattcacttaccaaatgccggatgaaaccaaccacggatgcgtcaggtttcgagcttcttctatcagcattgtgcagtacgcactgccttgttcatttttgttagccttggccccgtgc

SEQ ID NO: 4786 - DNA, 455 bp, Artificial; identical to SEQ ID NO: 4479
  TaSBEIIa-D allele with mutations introduced by TALEN pair TaSBEIIa_T03

SEQ ID NO: 4787 - DNA, 484 bp, Artificial; identical to SEQ ID NO: 3242
  TaSBEIIa-D allele with mutations introduced by TALEN pair TaSBEIIa_T03

SEQ ID NO: 4788 - DNA, 615 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaatgccgcaaaaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgtttagccttggccccgtgctggctcttgggccactg

SEQ ID NO: 4789 - DNA, 484 bp, Artificial; identical to SEQ ID NO: 3242
  TaSBEIIa-D allele with mutations introduced by TALEN pair TaSBEIIa_T03

SEQ ID NO: 4790 - DNA, 483 bp, Artificial; identical to SEQ ID NO: 3279
  TaSBEIIa-D allele with mutations introduced by TALEN pair TaSBEIIa_T03

SEQ ID NO: 4791 - DNA, 484 bp, Artificial; identical to SEQ ID NO: 3242
  TaSBEIIa-D allele with mutations introduced by TALEN pair TaSBEIIa_T03

SEQ ID NO: 4792 - DNA, 484 bp, Artificial; identical to SEQ ID NO: 3526
  TaSBEIIa-D allele with mutations introduced by TALEN pair TaSBEIIa_T03

SEQ ID NO: 4793 - DNA, 484 bp, Artificial; identical to SEQ ID NO: 3242
  TaSBEIIa-D allele with mutations introduced by TALEN pair TaSBEIIa_T03

SEQ ID NO: 4794 - DNA, 571 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggagccgcccaggtgcttgcccctgtagccgtacaccggcaacagccgctggaccgtctccagcgcctgcttgccaccattattgctgaaggtcctggtgcctgacggcgagagcgacgacttggcaagtccggcgcaacctgagaattacaggtacacacactcgtgccggtaaatcttcatacaatcgttattcacttaccaaatgcaggatgaaaccaaccacggatgcgtcaggtttcgagcttcttctatcagcattgtgcagtactgcactgccttgttcattttgttagccttggcccgtgctggctcttgggccactgaa

SEQ ID NO: 4795 - DNA, 560 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtagctcttgatccggcaacaaaccaccgcgccttgcagcacatcccccttcgccagctggcgtaatagcgaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgccgtcaggttttcgagcttcttctatcagcattgtgcagtactgcactgccttgttcattttgttagccttggccccgtgctggctcttgggccactgaa

SEQ ID NO: 4796 - DNA, 470 bp, Artificial; identical to SEQ ID NO: 4256
  TaSBEIIa-D allele with mutations introduced by TALEN pair TaSBEIIa_T03

SEQ ID NO: 4797 - DNA, 460 bp, Artificial
  TaSBEIIa-D allele with mutations introduced by TALEN pair TaSBEIIa_T03
gagatagctggattaggcgatcgtccgcttcctgaacctgtttattttttcccccgcgggggaaatgcgtttagtgtcaccccaggcccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcgcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 4798 - DNA, 483 bp, Artificial; identical to SEQ ID NO: 3279
  TaSBEIIa-D allele with mutations introduced by TALEN pair TaSBEIIa_T03

SEQ ID NO: 4799 - DNA, 468 bp, Artificial; identical to SEQ ID NO: 3287
  TaSBEIIa-D allele with mutations introduced by TALEN pair TaSBEIIa_T03

SEQ ID NO: 4800 - DNA, 510 bp, Artificial; identical to SEQ ID NO: 4122
  TaSBEIIa-D allele with mutations introduced by TALEN pair TaSBEIIa_T03

SEQ ID NO: 4801 - DNA, 455 bp, Artificial
  TaSBEIIa-D allele with mutations introduced by TALEN pair TaSBEIIa_T03
gagatagctggattaggcgatcgcgcttcctgaacctgtatttttttccccgcggggaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcatttttgcaggcgccgtcctgagccgcgcggccgtcctggtgcctgacggcgagagcgacgacttggcagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccc

SEQ ID NO: 4802 - DNA, 479 bp, Artificial; identical to SEQ ID NO: 3428
  TaSBEIIa-D allele with mutations introduced by TALEN pair TaSBEIIa_T03

SEQ ID NO: 4803 - DNA, 484 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4804 - DNA, 469 bp, Artificial; identical to SEQ ID NO: 3440
  TaSBEIIa-D allele with mutations introduced by TALEN pair TaSBEIIa_T03

SEQ ID NO: 4805 - DNA, 475 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttggg

SEQ ID NO: 4806 - DNA, 478 bp, Artificial; identical to SEQ ID NO: 3395
  TaSBEIIa-D allele with mutations introduced by TALEN pair TaSBEIIa_T03

SEQ ID NO: 4807 - DNA, 510 bp, Artificial; identical to SEQ ID NO: 4122
  TaSBEIIa-D allele with mutations introduced by TALEN pair TaSBEIIa_T03

SEQ ID NO: 4808 - DNA, 439 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcactgccttgttca

SEQ ID NO: 4809 - DNA, 520 bp, Artificial; identical to SEQ ID NO: 4660
  TaSBEIIa-D allele with mutations introduced by TALEN pair TaSBEIIa_T03

SEQ ID NO: 4810 - DNA, 484 bp, Artificial; identical to SEQ ID NO: 4383
  TaSBEIIa-D allele with mutations introduced by TALEN pair TaSBEIIa_T03

SEQ ID NO: 4811 - DNA, 485 bp, Artificial; identical to SEQ ID NO: 3501
  TaSBEIIa-D allele with mutations introduced by TALEN pair TaSBEIIa_T03

SEQ ID NO: 4812 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4813 - DNA, 478 bp, Artificial; identical to SEQ ID NO: 3395
  TaSBEIIa-D allele with mutations introduced by TALEN pair TaSBEIIa_T03

SEQ ID NO: 4814 - DNA, 470 bp, Artificial; identical to SEQ ID NO: 3580
  TaSBEIIa-D allele with mutations introduced by TALEN pair TaSBEIIa_T03

SEQ ID NO: 4815 - DNA, 479 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcca

SEQ ID NO: 4816 - DNA, 492 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagctcttctatcagcattgtgcagtactgcactgccttg

SEQ ID NO: 4817 - DNA, 482 bp, Artificial; identical to SEQ ID NO: 3313
  TaSBEIIa-D allele with mutations introduced by TALEN pair TaSBEIIa_T03

SEQ ID NO: 4818 - DNA, 504 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaaggtcctggtgcctgacggcgagagcgacgacttggcaagtccggcgcaacctgaagaattacaggtacacacactcgtgccggtaaatcttcatacaatcgttattcactttaccaaaatgccgggatgaaaccaaccacggatgcgtcaggtttcgagctcttctatcagcattgtgcagtactgcactgccttgttcattttg

SEQ ID NO: 4819 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4820 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtagcattgtctcactattgtagtcatccttgcattgcaggcgccgtcctgagccgcgcggcctctccgtcctggtgcctgacggtgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 4821 - DNA, 463 bp, Artificial
  TaSBEIIa-D allele with mutations introduced by TALEN pair TaSBEIIa_T03
  misc_feature (447): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggttttcgagcttcttctacagcattgtgcagtactgcactgccttgttcattttgttagccttggcccccgngctggtcttgggccac

SEQ ID NO: 4822 - DNA, 501 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaactgagctgccaaggcacacagggga

SEQ ID NO: 4823 - DNA, 454 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 4824 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatttgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4825 - DNA, 572 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaatgccgcaaaaagcaaggtcctggtgcctgacggcgagagcgacgacttggcaagtccggcgcaacctgaagaattacggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 4826 - DNA, 484 bp, Artificial; identical to SEQ ID NO: 3242
  TaSBEIIa-D allele with mutations introduced by TALEN pair TaSBEIIa_T03

SEQ ID NO: 4827 - DNA, 569 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaatccactcgtgcacccaactgatcttcagcatcttttactttcaccagcgtttctgggtgagcaaaaacaggaaggcaaaatgccgcaaaaagcaaggtcctggtgcctgacggcgagagcgacgacttggcaagtccggcgcaacctgaagaattacggtacacacactcgtgccggtaaatcttcatacaatcgttattcacttaccaaatgccggatgaaaccaaccacggatgcgtcaggtttcgagcttcttctatcagcattgtgcagtactgcactgccttg

SEQ ID NO: 4828 - DNA, 642 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcctccactgcggtcacgccgccagtggcgcagcaccacgaggcactggtcggccacgggtttacactttatgcttccggctcgtatgttgtgtgaaatatagcgcgcaaactaggataaattatctcaatccaaataatctgcaccggatctcgcccttacctgcagcaacaggagaagatcaaaccgaaggttaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaaggttttcgagcttcttctatcagcattgtgcagtactgcactgccttgttca

SEQ ID NO: 4829 - DNA, 481 bp, Artificial; identical to SEQ ID NO: 3573
  TaSBEIIa-D allele with mutations introduced by TALEN pair TaSBEIIa_T03

SEQ ID NO: 4830 - DNA, 484 bp, Artificial; identical to SEQ ID NO: 3242
  TaSBEIIa-D allele with mutations introduced by TALEN pair TaSBEIIa_T03

SEQ ID NO: 4831 - DNA, 483 bp, Artificial; identical to SEQ ID NO: 3279
  TaSBEIIa-D allele with mutations introduced by TALEN pair TaSBEIIa_T03

SEQ ID NO: 4832 - DNA, 523 bp, Artificial; identical to SEQ ID NO: 3792
  TaSBEIIa-D allele with mutations introduced by TALEN pair TaSBEIIa_T03

SEQ ID NO: 4833 - DNA, 661 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcctccactgcggtcacgccgccagtggcgcagcaccacgaggcactggtcggccacggtttacactttatgcttccggctcgtatgttgtgtgaaatatagcgcgcaaactggataattatctcaatccaaataatctgcaccggatctcgcccttacctgcagcaacaggagaagatcaaaccgaaggttaaggtcctggtgcctgacggcgagagcgacgacttggcaagtccgcgcaacctgaagaattacaggtacacacactcggtgccggtaaatcttcatacaatcgttattcacttaccaaatgccggatgaaaccaaccacggatgcgtcaaggttttcgagcttcttctatcagcattgtgcagtactgcactgccttgttcattttgttagccttggccccgtgc

SEQ ID NO: 4834 - DNA, 484 bp, Artificial; identical to SEQ ID NO: 3242
  TaSBEIIa-D allele with mutations introduced by TALEN pair TaSBEIIa_T03

SEQ ID NO: 4835 - DNA, 438 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaaatcttcatacaaatcgttattcacttaccaaaatgccggatgaaaaccaaaccacggatgcgtcaggttttcgagcttcttctatcagcattgtgcagtactgcactg

SEQ ID NO: 4836 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcaagcttcttctatcagcattgtgcactacttcactgccttgtgcagtttgttagctgtggccccgcgctggctcttgggccactgaa

SEQ ID NO: 4837 - DNA, 485 bp, Artificial; identical to SEQ ID NO: 4499
  TaSBEIIa-D allele with mutations introduced by TALEN pair TaSBEIIa_T03

SEQ ID NO: 4838 - DNA, 490 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttatttcacttaccaaaatgccggatgaaaccaaccacggatgcgtcaggttttcgagcttcttctatcagcattgtgcagtactgcactgccttgttcatttttgttagccttggccccgtgctggctcttgggccactgaa

SEQ ID NO: 4839 - DNA, 482 bp, Artificial; identical to SEQ ID NO: 3313
  TaSBEIIa-D allele with mutations introduced by TALEN pair TaSBEIIa_T03

SEQ ID NO: 4840 - DNA, 629 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcattttgcaggcgccgtcctgagccgcgcggcctctccaagcgcctgcttgccgccatcgtggctggcgatggccaccacctgctccggggtcaagccgtgggcctggcacagcaccggcaacagccgctgggatcttcacctagatccttttaaattaaaaatgaagttttaaatcaatctaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactg

SEQ ID NO: 4841 - DNA, 526 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctc

SEQ ID NO: 4842 - DNA, 478 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggccaaggtcctggtgcctgacggcgagagcgaccgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgtctggctcttgggccact

SEQ ID NO: 4843 - DNA, 534 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaggccagcaaaaggccaggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4844 - DNA, 570 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcattttgcaggcgccgtcctgagccgcgcggcctctccagtgactggtgagtactcaaccaagtcattctgagaatagtcagcatgttcactacggaacaagtcggaataaaagctaagaaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4845 - DNA, 440 bp, Artificial; identical to SEQ ID NO: 4155
  TaSBEIIa-D allele with mutations introduced by TALEN pair TaSBEIIa_T03

SEQ ID NO: 4846 - DNA, 480 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4847 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggcccccgtgctggctcttgggccactgaa

SEQ ID NO: 4848 - DNA, 460 bp, Artificial
  TaSBEIIa-D allele with mutations introduced by TALEN pair TaSBEIIa_T03
gagatagctggattaggcgatcgcgcttcctgaacctgtattttttccccgcgggaacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 4849 - DNA, 480 bp, Artificial; identical to SEQ ID NO: 3348
  TaSBEIIa-D allele with mutations introduced by TALEN pair TaSBEIIa_T03

SEQ ID NO: 4850 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggtgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4851 - DNA, 483 bp, Artificial; identical to SEQ ID NO: 3279
  TaSBEIIa-D allele with mutations introduced by TALEN pair TaSBEIIa_T03

SEQ ID NO: 4852 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4853 - DNA, 468 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggc

SEQ ID NO: 4854 - DNA, 485 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4855 - DNA, 478 bp, Artificial; identical to SEQ ID NO: 3395
  TaSBEIIa-D allele with mutations introduced by TALEN pair TaSBEIIa_T03

SEQ ID NO: 4856 - DNA, 479 bp, Artificial; identical to SEQ ID NO: 3428
  TaSBEIIa-D allele with mutations introduced by TALEN pair TaSBEIIa_T03

SEQ ID NO: 4857 - DNA, 584 bp, Artificial
  TaSBEIIa-D allele with mutations introduced by TALEN pair TaSBEIIa_T03
  misc_feature (440): n is a or c or t or g
gagatagctggattaggcgatcgcgcttcctgaacctgtattttttccccgcggggaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgacaccggataaggcgcagcggtcgggctgaacgggggttgcgggcgatctcgatcagctcgatgtacaaggtcctggtgccctgacggcgagagcgacgacttggcaagtccggcgcacctgaagaattacaggtacncacactcgtgccggtaaatcttcatacaatcgttattcacttaccaaatgccggtgaaaccaaccacggatgcgtcaggtttcgagcttcttctatcagcattgtgtcagtactgcactgccttgttcattttgttagccttgg

SEQ ID NO: 4858 - DNA, 483 bp, Artificial; identical to SEQ ID NO: 3279
  TaSBEIIa-D allele with mutations introduced by TALEN pair TaSBEIIa_T03

SEQ ID NO: 4859 - DNA, 480 bp, Artificial; identical to SEQ ID NO: 3859
  TaSBEIIa-D allele with mutations introduced by TALEN pair TaSBEIIa_T03

SEQ ID NO: 4860 - DNA, 466 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgct

SEQ ID NO: 4861 - DNA, 484 bp, Artificial; identical to SEQ ID NO: 3242
  TaSBEIIa-D allele with mutations introduced by TALEN pair TaSBEIIa_T03

SEQ ID NO: 4862 - DNA, 443 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccccgtgctgg

SEQ ID NO: 4863 - DNA, 576 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaaatgccgcaaaaagcaaggtcctggtgcctgacggcgagagcgacgacttggcaagtccggcgcaacctgaagaattacaggtacacacactcgtgccggtaaaatcttcatacaatcgttattcacttaccaaatgccggatgaaaccaaccacggatgcgtcaggtttcgagcttcttctatcagcattgtgcagtactgcactgccttgttca

SEQ ID NO: 4864 - DNA, 474 bp, Artificial; identical to SEQ ID NO: 4427
  TaSBEIIa-D allele with mutations introduced by TALEN pair TaSBEIIa_T03

SEQ ID NO: 4865 - DNA, 618 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagcccccgacacccgcccaacacccgctgaaggtcctggtgcctgacggcgagagcgacgacttggcaagtccggcgcaacctgaagaattacaggtacacacactcgtgccggtaaatcttcatacaatcgttattcacttacccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4866 - DNA, 484 bp, Artificial; identical to SEQ ID NO: 3526
  TaSBEIIa-D allele with mutations introduced by TALEN pair TaSBEIIa_T03

SEQ ID NO: 4867 - DNA, 479 bp, Artificial; identical to SEQ ID NO: 3326
  TaSBEIIa-D allele with mutations introduced by TALEN pair TaSBEIIa_T03

SEQ ID NO: 4868 - DNA, 569 bp, Artificial
  TaSBEIIa-D allele with mutations introduced by TALEN pair TaSBEIIa_T03
  misc_feature (477); (501): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcaataatggtggcaagcaggcgctggagacggtccagcggctgttgccggtgctgtgccaggcccacggcttgacccccagcaggtggtggcaaggtcctggtgcctgacggcgagagcgacgacttggcaagtccggcgcaacctgagaattacaggtacacacactcgtgccggtaaatcttcatacaatcgttattcacttaccaaatgccggatgaaaccaaccacggntgcgtcaggtttcgagcttcttcnatcagcattgtgcagtactgcactgccttgttcattttgttagccttggccccgtgctggctcttggg

SEQ ID NO: 4869 - DNA, 484 bp, Artificial; identical to SEQ ID NO: 3242
  TaSBEIIa-D allele with mutations introduced by TALEN pair TaSBEIIa_T03

SEQ ID NO: 4870 - DNA, 574 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaaatgccgcaaaaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttc

SEQ ID NO: 4871 - DNA, 484 bp, Artificial; identical to SEQ ID NO: 3242
  TaSBEIIa-D allele with mutations introduced by TALEN pair TaSBEIIa_T03

SEQ ID NO: 4872 - DNA, 534 bp, Artificial; identical to SEQ ID NO: 4843
  TaSBEIIa-D allele with mutations introduced by TALEN pair TaSBEIIa_T03

SEQ ID NO: 4873 - DNA, 486 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4874 - DNA, 487 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacaccatcgtgccgggaaatcttcatacaatcgttattcacttaccaaatgccggatgaaaccaagccgcggaggcgtcaggttttgagcttcttctatcagcattgtgcagtactgcactgccttgtgcatttttgttagccgtggccccgtgctggctcttgggccactgaa

SEQ ID NO: 4875 - DNA, 481 bp, Artificial; identical to SEQ ID NO: 3573
  TaSBEIIa-D allele with mutations introduced by TALEN pair TaSBEIIa_T03

SEQ ID NO: 4876 - DNA, 574 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaaatgccgcaaaaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 4877 - DNA, 451 bp, Artificial; identical to SEQ ID NO: 3646
  TaSBEIIa-D allele with mutations introduced by TALEN pair TaSBEIIa_T03

SEQ ID NO: 4878 - DNA, 482 bp, Artificial; identical to SEQ ID NO: 3313
  TaSBEIIa-D allele with mutations introduced by TALEN pair TaSBEIIa_T03

SEQ ID NO: 4879 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagactggtcgctggacggcggagagcgacgactgtcaggtccaggcgcaccactgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4880 - DNA, 438 bp, Artificial
  TaSBEIIa-D allele with mutations introduced by TALEN pair TaSBEIIa_T03
gagatagctggattaggcgatcgcctgcgtcagtgtcacccaggccctggtgttatcacggctttgatcatctcctcccattctgatattttctcactctttttcttcctgttcttgctgtaactgcaagttgtggcgttttttcactattgtagtcatccttgcattttgcaggcgccgtcctgagccgcgcggcctctggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 4881 - DNA, 479 bp, Artificial; identical to SEQ ID NO: 4015
  TaSBEIIa-D allele with mutations introduced by TALEN pair TaSBEIIa_T03

SEQ ID NO: 4882 - DNA, 484 bp, Artificial; identical to SEQ ID NO: 3526
  TaSBEIIa-D allele with mutations introduced by TALEN pair TaSBEIIa_T03

SEQ ID NO: 4883 - DNA, 482 bp, Artificial; identical to SEQ ID NO: 3313
  TaSBEIIa-D allele with mutations introduced by TALEN pair TaSBEIIa_T03

SEQ ID NO: 4884 - DNA, 499 bp, Artificial
  TaSBEIIa-D allele with mutations introduced by TALEN pair TaSBEIIa_T03
  misc_feature (467): n is a or c or t or g
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcccggagcaggtggtggccatcgccagccacgatggcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagnactgcactgccttgttcatttttgttagcctt

SEQ ID NO: 4885 - DNA, 484 bp, Artificial; identical to SEQ ID NO: 4383
  TaSBEIIa-D allele with mutations introduced by TALEN pair TaSBEIIa_T03

SEQ ID NO: 4886 - DNA, 473 bp, Artificial
  TaSBEIIa-D allele with mutations introduced by TALEN pair TaSBEIIa_T03
gagatagctggattaggcgatcgcgcttcctgaacctgtattttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctctt

SEQ ID NO: 4887 - DNA, 535 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtatcatccttgcattttgcaggcgccgtcctgagccgcgcggcctctccatacgtttggaactgacagaaccgcaacgttgaaggagccactcagccgcgggtttctggagttaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4888 - DNA, 479 bp, Artificial; identical to SEQ ID NO: 4812
  TaSBEIIa-D allele with mutations introduced by TALEN pair TaSBEIIa_T03

SEQ ID NO: 4889 - DNA, 480 bp, Artificial; identical to SEQ ID NO: 3284
  TaSBEIIa-D allele with mutations introduced by TALEN pair TaSBEIIa_T03

SEQ ID NO: 4890 - DNA, 479 bp, Artificial; identical to SEQ ID NO: 3326
  TaSBEIIa-D allele with mutations introduced by TALEN pair TaSBEIIa_T03

SEQ ID NO: 4891 - DNA, 456 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 4892 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgtttttcattctattgtagtcatccttgcattttgcaggcgccgtcctgagccgcgcggcctctggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4893 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgcccggatgaaaccaaccacggatgcgtcaggtttcgagcttcttctatcagcattgtgcagtactgcactgccttgttcattttgttagccttggcccccgtgctggctcttgggccactgaa

SEQ ID NO: 4894 - DNA, 484 bp, Artificial; identical to SEQ ID NO: 3526
  TaSBEIIa-D allele with mutations introduced by TALEN pair TaSBEIIa_T03

SEQ ID NO: 4895 - DNA, 588 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcattttgcaggcgccgtcctgagccgcgcggcctctccagtgaccgtgtccgggagctgcatgtgtcagaggttttcaccgtcatcaccgaaacgcgcgacaccggataaggcgcagcggtcgggctgaacgggggttcgggcgatctcgatcagctcgatgtacaaggtcctgggtgcctgacggcgagagcgacgacttggcaagtccggcgcaacctgaagaattgacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttgg

SEQ ID NO: 4896 - DNA, 580 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagacggtgcaggcgctgttgccggtgctgtgccaggcccacggctttgaccccggagcaggtggtggccatcgccagccacgatggcggcaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccgtgctggctcttgggccactgaa

SEQ ID NO: 4897 - DNA, 470 bp, Artificial; identical to SEQ ID NO: 3580
  TaSBEIIa-D allele with mutations introduced by TALEN pair TaSBEIIa_T03

SEQ ID NO: 4898 - DNA, 541 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggttgaaagcctcaacttgattcgcaacaaaaagaatccgctctgatactccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggcccgctg

SEQ ID NO: 4899 - DNA, 483 bp, Artificial; identical to SEQ ID NO: 3279
  TaSBEIIa-D allele with mutations introduced by TALEN pair TaSBEIIa_T03

SEQ ID NO: 4900 - DNA, 485 bp, Artificial; identical to SEQ ID NO: 4499
  TaSBEIIa-D allele with mutations introduced by TALEN pair TaSBEIIa_T03

SEQ ID NO: 4901 - DNA, 484 bp, Artificial; identical to SEQ ID NO: 3526
  TaSBEIIa-D allele with mutations introduced by TALEN pair TaSBEIIa_T03

SEQ ID NO: 4902 - DNA, 466 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactg

SEQ ID NO: 4903 - DNA, 485 bp, Artificial; identical to SEQ ID NO: 3793
  TaSBEIIa-D allele with mutations introduced by TALEN pair TaSBEIIa_T03

SEQ ID NO: 4904 - DNA, 482 bp, Artificial; identical to SEQ ID NO: 3278
  TaSBEIIa-D allele with mutations introduced by TALEN pair TaSBEIIa_T03

SEQ ID NO: 4905 - DNA, 488 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagccccgacacccgccaacacccgctgaaggtcctggtgcctgacggcgagagcgacgacttggcaagtccggcgcaacctgaagaattacaggtacacacactcgtgccggtaaatcttcatacaatcgttattcacttacc

SEQ ID NO: 4906 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4907 - DNA, 484 bp, Artificial; identical to SEQ ID NO: 3242
  TaSBEIIa-D allele with mutations introduced by TALEN pair TaSBEIIa_T03

SEQ ID NO: 4908 - DNA, 488 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgactttgggccaagttccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4909 - DNA, 484 bp, Artificial; identical to SEQ ID NO: 3242
  TaSBEIIa-D allele with mutations introduced by TALEN pair TaSBEIIa_T03

SEQ ID NO: 4910 - DNA, 518 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtagctcttgatccggcaaacaaaccaccgcgccttgcagcacatccccctttcgccagctggcgtaatagcgaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 4911 - DNA, 481 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4912 - DNA, 484 bp, Artificial; identical to SEQ ID NO: 3242
  TaSBEIIa-D allele with mutations introduced by TALEN pair TaSBEIIa_T03

SEQ ID NO: 4913 - DNA, 483 bp, Artificial
  TaSBEIIa-D allele with mutations introduced by TALEN pair TaSBEIIa_T03
gagatagctggattaggcgatcgcgcttcctgaacctgtattttttccccgcgggacgatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4914 - DNA, 580 bp, Artificial
  TaSBEIIa-D allele with mutations introduced by TALEN pair TaSBEIIa_T03
  misc_feature (504): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcaataatggtggcaagcaggcgctggagacggtccagcggctgttgccggtgctgtgccaggcccacggcttgaccccccagcaggtggtggcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttctttcnatcagcattgtgcagtactgcactgccttgttcattttgttagccttggccccgtgctggctcttgggccactgaa

SEQ ID NO: 4915 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4916 - DNA, 484 bp, Artificial; identical to SEQ ID NO: 3242
  TaSBEIIa-D allele with mutations introduced by TALEN pair TaSBEIIa_T03

SEQ ID NO: 4917 - DNA, 579 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtgcgttttttcactattgtagtcatccttgcattttgcaggcgccgtcctgagccgcgcggcctctccagagacggtgcaggcgctgttgccggtgctgtgccaggcccacggcttgaccccggagcaggtggtggccatcgccagccacgatggcggcaagcaaggtcctggtgcctgacggcgagagcgacgacttggcaagtccggcgcacctgaagaattacagggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4918 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgccggatgaaaccaaccatggatgcgtcaggtttcgagcttcttctatcagcattgtgcagtactgcactgccttgttcatttttgttagccttggcccccgtgctggctcttgggccactgaa

SEQ ID NO: 4919 - DNA, 546 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggtttttttgtttgcaagcagcagattacgcgcagaaaaaacaggaaggcaaaatgccgcaaaaaaggggaaggtcctggtgcctgacggcgagagcgacgacttggcaagtccggcgcaacctgaagaatttacaggtacacacactcgtgccggtaaatcttcatacaatcgttattcactttaccaaatgccgggatgaaaccaaccacggatgcgtcaggtttcgagcttcttctatcagcattgtgcagtactgcactgccttgttcattttgttagccttggccccgtgctggctc

SEQ ID NO: 4920 - DNA, 483 bp, Artificial; identical to SEQ ID NO: 3279
  TaSBEIIa-D allele with mutations introduced by TALEN pair TaSBEIIa_T03

SEQ ID NO: 4921 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttccagtgctgctctgacggcgagagcgacgacttggcaagtccggcgcaacctgaagaattacaggtacacacactcgtgccggtaaatcttcatacaatcgttattcactttaccaaaatgcccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4922 - DNA, 422 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaatcttcatacaatcgttattcacttaccaaaatgccggtgaaaccaaccacggatgcgtcaggtttcgagcttcttctacagcattgtgcagtactgcactgccttgttca

SEQ ID NO: 4923 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgactttggcaagtccggcgcaacctgaagaattacaggtacacacactcgtgccggtaaatcttcatacaatcgttattcacttaccaaatgcccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4924 - DNA, 483 bp, Artificial; identical to SEQ ID NO: 3279
  TaSBEIIa-D allele with mutations introduced by TALEN pair TaSBEIIa_T03

SEQ ID NO: 4925 - DNA, 481 bp, Artificial; identical to SEQ ID NO: 3573
  TaSBEIIa-D allele with mutations introduced by TALEN pair TaSBEIIa_T03

SEQ ID NO: 4926 - DNA, 561 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggttgaaagcctcaacttgattcgcaacaaaaagaatccgctctgatactccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcattttgttagccttggccccgtgctggctcttgggccactgaa

SEQ ID NO: 4927 - DNA, 473 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 4928 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcggtcctggtgcctgacggcgagagcgacgacttggcaagtccggcgcaacctgaagaattacaggtacacacactcgtgccggtaaatcttcatacaatcgttattcacttaccaaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 4929 - DNA, 663 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcctccactgcggtcacgccgccagtggcgcagcaccacgaggcactggtcggccacgggtttacactttatgcttccggctcgtatgttgtgtgaaatatagcgcgcaaactggataaattatctcaatccaaataatctgcaccggatctcgcccttacctgcagcaacaggagaagatcaaaccgaaggttaaggtcctggtgcctgacggcgagagcgacgacttggcaagtccggcgcaacctgaagaattacaggtacacacacttcgtgccggtaaatcttcatacaatcgttattcacttaccaaatgccggatgaaaccaaccacggatgcgtcaaggtttcgagcttcttctatcagcttgtgcagtactgcactgccttgttcattttgttagccttggccccgtgc

SEQ ID NO: 4930 - DNA, 474 bp, Artificial; identical to SEQ ID NO: 4244
  TaSBEIIa-D allele with mutations introduced by TALEN pair TaSBEIIa_T03

SEQ ID NO: 4931 - DNA, 527 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggaaagaacatgtgagcaaaaggccagcaaaaaggccggctgcgccactgtcgaacgaaccttcggctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgcccttgttcattttgttagccttggccccgtgc

SEQ ID NO: 4932 - DNA, 484 bp, Artificial; identical to SEQ ID NO: 3239
  TaSBEIIa-D allele with mutations introduced by TALEN pair TaSBEIIa_T03

SEQ ID NO: 4933 - DNA, 479 bp, Artificial; identical to SEQ ID NO: 3371
  TaSBEIIa-D allele with mutations introduced by TALEN pair TaSBEIIa_T03

SEQ ID NO: 4934 - DNA, 484 bp, Artificial; identical to SEQ ID NO: 3400
  TaSBEIIa-D allele with mutations introduced by TALEN pair TaSBEIIa_T03

SEQ ID NO: 4935 - DNA, 546 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaaatgccgcaaaaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaacacggatgcgtcaggtttcgagcttcttctatcagca

SEQ ID NO: 4936 - DNA, 480 bp, Artificial; identical to SEQ ID NO: 4739
  TaSBEIIa-D allele with mutations introduced by TALEN pair TaSBEIIa_T03

SEQ ID NO: 4937 - DNA, 457 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtg

SEQ ID NO: 4938 - DNA, 478 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4939 - DNA, 487 bp, Artificial
  TaSBEIIa-D allele with mutations introduced by TALEN pair TaSBEIIa_T03
  misc_feature (66): n is a or c or t or g
gagatagctggattaggcgatcgcgcttcctgaaccctgtatttttttccccgcgggggaaatgcnttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4940 - DNA, 481 bp, Artificial; identical to SEQ ID NO: 3504
  TaSBEIIa-D allele with mutations introduced by TALEN pair TaSBEIIa_T03

SEQ ID NO: 4941 - DNA, 482 bp, Artificial; identical to SEQ ID NO: 3313
  TaSBEIIa-D allele with mutations introduced by TALEN pair TaSBEIIa_T03

SEQ ID NO: 4942 - DNA, 494 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttg

SEQ ID NO: 4943 - DNA, 452 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 4944 - DNA, 554 bp, Artificial
  TaSBEIIa-D allele with mutations introduced by TALEN pair TaSBEIIa_T03
  misc_feature (484): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcctccactgcggtcacgccgccagtggcgcagcaccacgaggcactggtcggccacggtttacacttatgcttccggctcgtatgttgtgtgaaatatagcgcgcaaactaggataaattatctcaatccaaataatctgcaccggatctcgcccttacctgcagcaacaggagaagatcaaaccgaaggttaaggtcctggtgcctgacggcgagagcgacgacttggcaagtccggngcaacctgaagaattacaggtacacacactcggtgccggtaaatcttcatacaatcgttattcacttacc

SEQ ID NO: 4945 - DNA, 485 bp, Artificial; identical to SEQ ID NO: 3515
  TaSBEIIa-D allele with mutations introduced by TALEN pair TaSBEIIa_T03

SEQ ID NO: 4946 - DNA, 481 bp, Artificial; identical to SEQ ID NO: 3573
  TaSBEIIa-D allele with mutations introduced by TALEN pair TaSBEIIa_T03

SEQ ID NO: 4947 - DNA, 460 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccaaggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 4948 - DNA, 456 bp, Artificial
  TaSBEIIa-D allele with mutations introduced by TALEN pair TaSBEIIa_T03
  misc_feature (439): n is a or c or t or g
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcattttgcaggcgccgtcctgagcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggttttcgagcttcttctacagcattgtgcagtactgcactgccttgttcattttgttagccttggccccgngctggtcttgggccact

SEQ ID NO: 4949 - DNA, 603 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagcgcctgcttgccgccatcgtggctggcgatggccaccacctgctccgggtcaagccgtgggcctggcacagcaccggcaacagccgctgggatcttcacctagatccttttaaattaaaaatgaagttttaaatcaatctaaggtcctggtgcctgacggcgagagcgacgacttggcaagtccggcgcaactgaagaattacaggtacacacactcgtgccggtaaatcttcatacaatcgttattcacttaccaaatgccggatgaaaccaaccacggattgcgtcaggttttcgagcttcttctatcagcattgtgcagtactgcactgcctttgttcatttttgttagccttgg

SEQ ID NO: 4950 - DNA, 411 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtagctcttgatccggcaaacaaaccaccgcgccttgcagcacatccccttctgccagctggcgtatagcgaaaggtcctggtgcctgacggcgagagcgacgacttggcaagtccggcgcaacctgaagaattacaggtacacacactcgtgccggtaaatcttca

SEQ ID NO: 4951 - DNA, 481 bp, Artificial; identical to SEQ ID NO: 3286
  TaSBEIIa-D allele with mutations introduced by TALEN pair TaSBEIIa_T03

SEQ ID NO: 4952 - DNA, 521 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcacgacggccagtgaattcgagctcggtacctcgcgaatgcatctagatccatgcttccggctcgtatgttgtgtggaggtcctggtgcctgacggcgagagcgacgacttggcaagtccggcgcaacctgaagaattacaggtacacacactcgtgccggtaaatcttcatacaattcggttatttcacttacccaaattgccggtgaaaccaaccacggatgcgtcaggtttcgagcttcttctatcagcattgtgcagtactgcactgccttgttca

SEQ ID NO: 4953 - DNA, 507 bp, Artificial
  TaSBEIIa-D allele with mutations introduced by TALEN pair TaSBEIIa_T03
gagatagctggattaggcgatcgcgcttcctgaacctgttattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttatttcactttaccaaaatgcccgggatgaaacccaacccacggatgcgtcaggtttcgagcttcttctatcagcattgtgcagtactgcactgccttgttcattttgttagccttggccccgtgctggctcttgggccactgaacgagactgccaaggcaca

SEQ ID NO: 4954 - DNA, 501 bp, Artificial
  TaSBEIIa-D allele with mutations introduced by TALEN pair TaSBEIIa_T03
  misc_feature (411): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaaggtcctggtgcctgacggcgagagcgacgacttggcaagtccggcgcaacctgaagaattacaggtacacacactcgtgccggtaaatcttcatacaatcgttattcacttnccaaatgccggatgaaaccaaccacggatgcgtcaggtttcgagctcttctatcagcattgtgcagtactgcactgccttgttcattttg

SEQ ID NO: 4955 - DNA, 456 bp, Artificial; identical to SEQ ID NO: 3581
  TaSBEIIa-D allele with mutations introduced by TALEN pair TaSBEIIa_T03

SEQ ID NO: 4956 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcatttttgttagccttggccccgtgctggctcttgggccactg

SEQ ID NO: 4957 - DNA, 440 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctc

SEQ ID NO: 4958 - DNA, 504 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaaccattattgcgcgttcaaaagtcgcctaccgcacagatgcgtaaggagaaaaggtcctggtgcctgacggcgagagcgacgacttggcaagtccggcgcaacctgaagaattacaggtacacacactcgtgccggtaaatcttcatacaatcgttattcacttaccaaatgccgggatgaaaccaaccacggatgcgtcaggtttcgagcttcttctatcagcattgtgcagtactgcactgccttgttcattttg

SEQ ID NO: 4959 - DNA, 484 bp, Artificial; identical to SEQ ID NO: 3526
  TaSBEIIa-D allele with mutations introduced by TALEN pair TaSBEIIa_T03

SEQ ID NO: 4960 - DNA, 460 bp, Artificial
  TaSBEIIa-D allele with mutations introduced by TALEN pair TaSBEIIa_T03
  misc_feature (328): n is a or c or t or g
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttccggttcccaacgatcaaggcgagttacaccgaactgagatacctacagcgtgagctaaggtcctggtgcctgacggcgagagcgncgacttgggcaagtccggcgcaacctgaagaattacaggtacacacactcgtgccggtaaatcttcatacaacgttattcacttaccaaatgccggatgaaaccaaccacggatgcgtcaggtttcgagctt

SEQ ID NO: 4961 - DNA, 451 bp, Artificial; identical to SEQ ID NO: 3761
  TaSBEIIa-D allele with mutations introduced by TALEN pair TaSBEIIa_T03

SEQ ID NO: 4962 - DNA, 484 bp, Artificial; identical to SEQ ID NO: 3239
  TaSBEIIa-D allele with mutations introduced by TALEN pair TaSBEIIa_T03

SEQ ID NO: 4963 - DNA, 536 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcacgacggccagtgaattcgagctcggtacctcgcgaatgcatctagatccatgcttccggctcgtatgttgtgtggaggtcctggtgcctgacggcgagagcgacgacttggcaagtccggcgcaacctgaagaattacaggtacacacactcgtgccggtaaatcttcatagcaatcgttattcacttaccaaattgccggatgaaacaaccacggatgccgtcaggtttcgagcttcttctatcagtcattgtgcagttactgcactgccttgttcattttgttagccttgg

SEQ ID NO: 4964 - DNA, 484 bp, Artificial
  TaSBEIIa-D allele with mutations introduced by TALEN pair TaSBEIIa_T03
  misc_feature (289): n is a or c or t or g
gagatagctggattaggcgatcgcgcttcctgaacctgtattttttccccgcggggaaatgcgttagtgtcacccaggccctggtgttaccacggctttgatcatcctcgtttcattctgatatatattttctcactctttttcttcctgttcttgctgtaactgcaagttgtgcgttttttcactattgtagtcatccttgcattttgcaggcgccgtcctgagccgcgcggcctctccaaggtcctggtgcctgacggcgagagcgacgactttggccaagtccggngcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4965 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctctcctggtgcctgacggcgagagcgacgacttggcaagtccggcgcaacctgaagaattacaggtacacacactcgtgccggtaaatcttcatacaatcgttattcacttaccaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 4966 - DNA, 596 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaatgccgcaaaaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgtttagccttggccccg

SEQ ID NO: 4967 - DNA, 503 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttg

SEQ ID NO: 4968 - DNA, 471 bp, Artificial; identical to SEQ ID NO: 4506
  TaSBEIIa-D allele with mutations introduced by TALEN pair TaSBEIIa_T03

SEQ ID NO: 4969 - DNA, 484 bp, Artificial; identical to SEQ ID NO: 4383
  TaSBEIIa-D allele with mutations introduced by TALEN pair TaSBEIIa_T03

SEQ ID NO: 4970 - DNA, 481 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4971 - DNA, 483 bp, Artificial; identical to SEQ ID NO: 3279
  TaSBEIIa-D allele with mutations introduced by TALEN pair TaSBEIIa_T03

SEQ ID NO: 4972 - DNA, 620 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagcgcctgcttgccgccatcgtggctggcgatggccaccacctgctccggggtcaagccgtgggcctggcacagcaccggcaacagccgctgggatcttcacctagatccttttaaattaaaaatgaagttttaaatcaatctaaggtcctggtgcctgacggcgagagcgacgacttggcaagtccggcgcaactgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgcctttgttcatttttgttagccttggccccgtgctggctctt

SEQ ID NO: 4973 - DNA, 582 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagagacggtgcaggcgctgttgccggtgctgtgccaggcccacggctttgaccccggagcaggtggtggccatcgccagccacgatggcggcaagcaaggtcctggtgcctgacggcgagagcgacgacttggcaagtccggcgcaacctgaagaattacagggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4974 - DNA, 481 bp, Artificial; identical to SEQ ID NO: 3504
  TaSBEIIa-D allele with mutations introduced by TALEN pair TaSBEIIa_T03

SEQ ID NO: 4975 - DNA, 486 bp, Artificial; identical to SEQ ID NO: 4476
  TaSBEIIa-D allele with mutations introduced by TALEN pair TaSBEIIa_T03

SEQ ID NO: 4976 - DNA, 573 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatctttttactttcaccagcgtttctgggtgagcaaaaacaggaaggcaaatgccgcaaaaagcaaggtcctggtgcctgacggcgagagcgacgacttggcaagtccggcgcaacctgaagaattacaggtacacacactcgtgccggtaaatcttcatcaatcgttattcacttaccaaatgccggatgaaaccaaccacggatgcgtcaggtttcgagcttcttctatcagcattgtgcagtactgcactgccttgttc

SEQ ID NO: 4977 - DNA, 464 bp, Artificial
  TaSBEIIa-D allele with mutations introduced by TALEN pair TaSBEIIa_T03
  misc_feature (54); (63): n is a or c or t or g
gagatagctggattaggcgatcgcgcttcctgaacctgtattttccttggaccnggagtgtgncacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4978 - DNA, 486 bp, Artificial; identical to SEQ ID NO: 4476
  TaSBEIIa-D allele with mutations introduced by TALEN pair TaSBEIIa_T03

SEQ ID NO: 4979 - DNA, 485 bp, Artificial; identical to SEQ ID NO: 3515
  TaSBEIIa-D allele with mutations introduced by TALEN pair TaSBEIIa_T03

SEQ ID NO: 4980 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggctgtttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4981 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcactttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4982 - DNA, 482 bp, Artificial; identical to SEQ ID NO: 3313
  TaSBEIIa-D allele with mutations introduced by TALEN pair TaSBEIIa_T03

SEQ ID NO: 4983 - DNA, 548 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggttgaaagcctcaacttgattcgcaacaaaaagaatccgctctgatactccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 4984 - DNA, 564 bp, Artificial
  TaSBEIIa-D allele with mutations introduced by TALEN pair TaSBEIIa_T03
  misc_feature (428): n is a or c or t or g
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtagctcttgatccggcaaacaaaccaccgcgccttgcagcacatccccctttcgccagctggcgtatagcgaaaggtcctggtgcctgacggcgagagcgacgacttggcaagtccggcgcaacctgaagaattacaggtacacacactcgtgccggtaaatcttcatacaatcgttattcncttacccaaaatgccggatgaaaaccaaccacggatgcgtcaggttttcgagcttcttctatcagcattgtgcagtactgcactgccttgttcattttgttagccttggccccgtgctggctcttgggccactgaa

SEQ ID NO: 4985 - DNA, 615 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagccccgacacccgccaacacccgctgaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4986 - DNA, 472 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctctgggccactgaa

SEQ ID NO: 4987 - DNA, 561 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggttgaaagcctcaacttgattcgcaacaaaaagaatccgctctgatactccgtgggaaggtcctggtgcctgacggcgagagcgacgacttggcaagtccggcgcaacctgaagaattacaggtacacacactcgtgcccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 4988 - DNA, 485 bp, Artificial
  TaSBEIIa-D allele with mutations introduced by TALEN pair TaSBEIIa_T03
gagatagctggattaggcgatcgcgcttcctgaacctgtattttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 4989 - DNA, 463 bp, Artificial
  TaSBEIIa-D allele with mutations introduced by TALEN pair TaSBEIIa_T03
  misc_feature (447): n is a or c or t or g
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggttttcgagcttcttctatcagcattgtgcagtactgcactgccttgttcattttgttagcttggccccgngctggtcttgggccac

SEQ ID NO: 4990 - DNA, 454 bp, Artificial
  TaSBEIIa-D allele with mutations introduced by TALEN pair TaSBEIIa_T03
gagatagctggattaggcgatcgcgcttcctgaacctgtattttttccccgcgggaagatgcgttagtgtcacccaggccctggtgttaccacggctttgatcattcctcgtttcattctgatatatattttctcactctttttcttcctgttcttgctgtaaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtg

SEQ ID NO: 4991 - DNA, 484 bp, Artificial; identical to SEQ ID NO: 4803
  TaSBEIIa-D allele with mutations introduced by TALEN pair TaSBEIIa_T03

SEQ ID NO: 4992 - DNA, 477 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctgtgcctgacggcgagagcgacgacttggcaagtccggcgcaacctgaagaattacaggtacacacactcgtgccggtaaatcttcatacaatcgttatttcactttaccaaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 4993 - DNA, 503 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcattttgcaggcgccgtcctgagccgcgcggcctctccagggtttttttgtttgcaagcagcagattatcgcgcagaaaaaacaggaaggcaaaatgccgcaaaaaaggggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgc

SEQ ID NO: 4994 - DNA, 441 bp, Artificial; identical to SEQ ID NO: 3704
  TaSBEIIa-D allele with mutations introduced by TALEN pair TaSBEIIa_T03

SEQ ID NO: 4995 - DNA, 579 bp, Artificial
  TaSBEIIa-D allele with mutations introduced by TALEN pair TaSBEIIa_T03
gagatagctggattaggcgatcgcgcttcctgaacctgtatttttttcccccgcggggaaatgcgttagtgtcacccaggccctggtgattaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagcgcctgcttgccgccatcgtggctggcgatggcccaccacctgctccgggtcaagccgtgggcctggcacagcaccggcaacagccgctgggatcttcacctagatccttttaaattaaaaatgaagttttaatcaatctaaggtcctggtgcctgacggcgagagcgacgacttggcagtccggcgcaacctgaagaattacaggtacacacactcgtgccggtaaatcttcatacaatcgttatttcacttaccaaatgccggatgaaaccaaccacggatgcgtcaggttttcgagcttcttctatcagcattgtgcagtactgcact

SEQ ID NO: 4996 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttatttcactttaccaaatgccggatggaaaccaaccacggatgcgtcaggtttcgagcttcttctatcagcattgtgcagtactgcactgccttgttcattttgttagccttggccccgtgctggctcttgggccactgaa

SEQ ID NO: 4997 - DNA, 479 bp, Artificial; identical to SEQ ID NO: 3308
  TaSBEIIa-D allele with mutations introduced by TALEN pair TaSBEIIa_T03

SEQ ID NO: 4998 - DNA, 423 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctacagcattgtgcagtactgcactgccttgttca

SEQ ID NO: 4999 - DNA, 481 bp, Artificial; identical to SEQ ID NO: 3504
  TaSBEIIa-D allele with mutations introduced by TALEN pair TaSBEIIa_T03

SEQ ID NO: 5000 - DNA, 429 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtgaccgtgtccgggagctgcatgtgtcagaggttttcaccgtcatcaccgaaacgcgcgcaccggataaggcgcagcggtcggctgaacgggggttcgggcgatctcgatcagctcgatgtacaaggtcctggtgcctgacggcgagagcgacgacttggcaagtccggcgcaacctgaagaatt

SEQ ID NO: 5001 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttaggtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcctggtgcctgacggcgagagcgacgactttgggccaagttccggcgcaacctgaagaattacaggtacacacactcgtgccggtaaatcttcatacaatcgttattcactttaccaaaatgcccggatgaaaccaaccacggatgcgtcaggtttcgagcttcttctatcagcattgtgcagtactgcactgccttgttcattttgttagccttggccccgtgctggctcttgggccactgaa

SEQ ID NO: 5002 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagtcctggtgcctgacggcgagagcgacgacttgcaagtccgcgcacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 5003 - DNA, 452 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaatcttcatacaatcgttattcacttaccaaaatgcccggatgaaaccaaccacggatgcgtcaggttttcgagcttcttctacagcattgtgcagtactgcactgcccttgttcattttgttagccttggcccccgtgct

SEQ ID NO: 5004 - DNA, 566 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaatgccgcaaaaagcaaggtcctggtgcctgacggcgagagcgacgacttggcaagtccggcgcaacctgaagaattacaggtacacacactcgtgccggtaaatcttcatacgaatcgttattcacttaccaatgccggatgaaaccaaccacggatgcgtcaggtttcgagcttcttctatcagcattgtgcagtactgcactgcc

SEQ ID NO: 5005 - DNA, 482 bp, Artificial; identical to SEQ ID NO: 3313
  TaSBEIIa-D allele with mutations introduced by TALEN pair TaSBEIIa_T03

SEQ ID NO: 5006 - DNA, 531 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggagccgcccaggtgcttgcccctgtagccgtacaccggcaacagccgctggaccgtctccagcgcctgcttgccaccattattgctgaaggtcctggtgccctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 5007 - DNA, 485 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcaagcttcttctatcagcattgtgcactacttcactgccttgtgcagtttgttagctgtggcccccgcgctggctcttgggccactgaa

SEQ ID NO: 5008 - DNA, 484 bp, Artificial; identical to SEQ ID NO: 3242
  TaSBEIIa-D allele with mutations introduced by TALEN pair TaSBEIIa_T03

SEQ ID NO: 5009 - DNA, 484 bp, Artificial; identical to SEQ ID NO: 3239
  TaSBEIIa-D allele with mutations introduced by TALEN pair TaSBEIIa_T03

SEQ ID NO: 5010 - DNA, 416 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaaatgccggatgaaaccaaccacggatgcgtcaggttttcgagcttcttctatcagcattgtgcagtactgcact

SEQ ID NO: 5011 - DNA, 485 bp, Artificial; identical to SEQ ID NO: 3515
  TaSBEIIa-D allele with mutations introduced by TALEN pair TaSBEIIa_T03

SEQ ID NO: 5012 - DNA, 483 bp, Artificial
  TaSBEIIa-D allele with mutations introduced by TALEN pair TaSBEIIa_T03
  misc_feature (39): n is a or c or t or g
gagatagctggattaggcgatcgcgcttcctgaacctgnatttttttccccgcggggaagtgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctggtcctggtgcctgacggcgagagcgacgactttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 5013 - DNA, 481 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggctgtttttcactattgtagtcatccttgcattttgcaggcgccgtcctgagccgcgcggcctctccgtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 5014 - DNA, 482 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactg

SEQ ID NO: 5015 - DNA, 404 bp, Artificial
  TaSBEIIa-D allele with mutations introduced by TALEN pair TaSBEIIa_T03
  misc_feature (296): n is a or c or t or g
gagatagctggattaggcgatcgcgcttcctgaacctgtattttttccccgcggggaaatgcgttaagtgtcacccaggccctggtgttaccacggctttgatcatcctcgtttcattctgatatatattttctcactctttttcttcctgttcttgctgtaactgcaagttgtggcgttttttcactattgtagtcatccttgcattttgcaggcgccgtcctgagccgcgcggcctctgcctgacggcgagagcgacgacttggcaagtccgcgcaacctgagaattacaggtncacacactcgtgccggtaaatcttcatacatcgttattcacttaccaaatgccggatgaaaccaaccacggatgcgtcaggtttcgagcttcttctatcagcattgtg

SEQ ID NO: 5016 - DNA, 485 bp, Artificial; identical to SEQ ID NO: 4227
  TaSBEIIa-D allele with mutations introduced by TALEN pair TaSBEIIa_T03

SEQ ID NO: 5017 - DNA, 483 bp, Artificial; identical to SEQ ID NO: 3279
  TaSBEIIa-D allele with mutations introduced by TALEN pair TaSBEIIa_T03

SEQ ID NO: 5018 - DNA, 568 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcattttgcaggcgccgtcctgagccgcgcggcctctccagtgactggtgagtactcaaccaagtcattctgagaatagtcagcatgttcactacggaacaagtcggaataaagctaagaaaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 5019 - DNA, 669 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcctccactgcggtcacgccgccagtggcgcagcaccacgaggcactggtcggccacgggtttacactttatgcttccggctcgtatgttgtgtgaaatatagcgcgcaaactaggataaattatctcaatccaaataatctgcaccggatctcgcccttacctgcagcaacaggagaagatcaaaccgaaggttaaggtcctggtgcctgacggcgagagcgacgacttggcaagtccgcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 5020 - DNA, 528 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggagccgcccaggtgcttgccctgtagccgtacaccggcaacagccgctggaccgtctccagcgcctgcttgccaccattattgctgaaggtcctggtgccctgacggcgagagcgacgacttggcaagtcggcgcaacctgagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 5021 - DNA, 484 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaaggtcctggtgcctgacggcgagagcgaccgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 5022 - DNA, 560 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtagctcttgatccggcaaacaaaccaccgcgccttgcagcacatccccctttcgccagctggcgtaatagcgaaaggtcctggtgcctgacggcgagagcgacgacttggcaagtccggcgcaacctgaagaattacaggtacacacactcgtgccggtaaatcttcatacaatcgttattcacttaccaaatgccggtgaaaccaaccacggatgcgtcaggtttcgagcttcttctatcagcattgtgcagtactgcactgccttgttcattttgttagccttggccccgtgctggctcttgggccactgaa

SEQ ID NO: 5023 - DNA, 483 bp, Artificial; identical to SEQ ID NO: 3279
  TaSBEIIa-D allele with mutations introduced by TALEN pair TaSBEIIa_T03

SEQ ID NO: 5024 - DNA, 480 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcactttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 5025 - DNA, 478 bp, Artificial; identical to SEQ ID NO: 3395
  TaSBEIIa-D allele with mutations introduced by TALEN pair TaSBEIIa_T03

SEQ ID NO: 5026 - DNA, 465 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggcccccgtgctggctcttgggccactg

SEQ ID NO: 5027 - DNA, 481 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttctgctgtaactgcaagttgtggcgttttttcactattgtagtcatccttgcattttgcaggcgccgtcctgagccgcgcggcctctgtcctggtgcctgacggcgagagcgacgacttggcaagtccggcgcaacctgaagaattacaggtacacacactcgtgccggtaaatcttcatacaatcgttattcacttaccaaatgcccggatgaaaccaaccacggatgcgtcaggtttcgagcttcttctatcagcattgtgcagtactgcactgccttgttcatttttgttagccttggccccgtgctggctcttgggccactgaa

SEQ ID NO: 5028 - DNA, 490 bp, Artificial
  TaSBEIIa-D allele with mutations introduced by TALEN pair TaSBEIIa_T03
gagatagctggattaggcgatcgcgcttcctgaacctgtatttttttccccgcgggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcattttgcaggcgccgtcctgagccgcgcggcctctccaaggtcctggtgcctgacggcgagagcgacgacttggcaagtccggcgcaacctgaagaattacaggtatacacactcgtgccggtaaatcttcatacaatcgttattcacttaccaaaatgcccggatgaaaccaaccacggatgcgtcaggtttcgagcttcttctatcagcattgtgcagtactgcactgccttgttcatttttgttagccttggccccgtgctggctcttgggccactgaa

SEQ ID NO: 5029 - DNA, 485 bp, Artificial
  TaSBEIIa-D allele with mutations introduced by TALEN pair TaSBEIIa_T03
gagatagctggattaggcgatcgcgcttcctgaacctgtattttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcaggtcctggtgcctgacggcgagagcgacgacttggcaagtccggcgcaacctgaagaattacaggtacacacactcgtgccggtaaatcttcatacaatcgttattcacttaccaaaatgccgggatgaaaccaaccacggatgcgtcaggtttcgagcttcttctatcagcattgtgcagtactgcactgccttgttcattttgttagccttggccccgtgctggctcttgggccactgaa

SEQ ID NO: 5030 - DNA, 642 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcctccactgcggtcacgccgccagtggcgcagcaccacgaggcactggtcggccacgggtttacactttatgcttccggctcgtatgttgtgtgaaatatagcgcgcaaactaggataaattatctcaatccaaataatctgcaccggatctcgcccttacctgcagcaacaggagaagatcaaaccgaaggttaaggtcctggtgcctgacggcgagagcgacgacttggcaagtccggcgcaacctgaagaattacaggtacacacactcggtgccggtaaatcttcatacaatcgttattcacttaccaaatgccggatgaaaccaaccacggatgcgtcagggtttcgagcttcttctatcagcattgtgcagtactgcactgccttgttca

SEQ ID NO: 5031 - DNA, 485 bp, Artificial; identical to SEQ ID NO: 4499
  TaSBEIIa-D allele with mutations introduced by TALEN pair TaSBEIIa_T03

SEQ ID NO: 5032 - DNA, 486 bp, Artificial; identical to SEQ ID NO: 4756
  TaSBEIIa-D allele with mutations introduced by TALEN pair TaSBEIIa_T03

SEQ ID NO: 5033 - DNA, 479 bp, Artificial; identical to SEQ ID NO: 3308
  TaSBEIIa-D allele with mutations introduced by TALEN pair TaSBEIIa_T03

SEQ ID NO: 5034 - DNA, 434 bp, Artificial
  TaSBEIIa-D allele with mutations introduced by TALEN pair TaSBEIIa_T03
gagatagctggattaggcgatcgcgcttcctgaacctgtatttttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggccgtcctggtgcctgacggcgagagcgacgacttggcaagtccggcgcaacctgaagattacaggtacacacactcgtgccggtaaatcttcatacaatcgttattcacttaccaaatgccggatgaaccaaccacggatgcgtcaggtttcgagcttcttctatcagcattgtgcagtactgcactgccttgttca

SEQ ID NO: 5035 - DNA, 560 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaaatgccgcaaaaaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtac

SEQ ID NO: 5036 - DNA, 479 bp, Artificial; identical to SEQ ID NO: 3308
  TaSBEIIa-D allele with mutations introduced by TALEN pair TaSBEIIa_T03

SEQ ID NO: 5037 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctctccaagcgcctgcttgccgccatcgtggctggcgatggcccaccacctgctccggggtcaagccgtgggcctggcacagcaccggcaacagcccgctgggatcttcacctagatccttttaaattaaaaatgaagttttaaatcaatctaaggtcctggtgcctgacggcgagagcgacgacttggcagtccggcgcaacctgaagattacaggtacacacactcgtgccggtaaatcttcatacaat

SEQ ID NO: 5038 - DNA, 564 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaaacaggaaggcaaaaatgccgcaaaaaagcaaggtcctggtgcctgacggcgagagcgacgacttggcaagtccggcgcaacctgaagaattacaggtacacacactcgtgccggtaaaatcttcatacaatcgttattcacttaccaaatgccggatgaaaccaaccacggatgcgtcaggtttcgagcttcttctatcagcattgtgcagtac

SEQ ID NO: 5039 - DNA, 502 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagcccggagcaggtggtggccatcgccagccacgatggcggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacgggatgcgtcaggttttcgagcttcttctatcagcattgtgcagtactgcactgccttgttcatttttgttagccttgg

SEQ ID NO: 5040 - DNA, 483 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggctgtttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 5041 - DNA, 561 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggttgaaagcctcaacttgattcgcaacaaaaagaatccgctctgatactccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 5042 - DNA, 496 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaccattattgcgcgttcaaaagtcgcctaccgcacagatgcgtaaggagaaaaggtcctggtgcctgacggcgagagcgacgacttggcaagtccagcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttca

SEQ ID NO: 5043 - DNA, 670 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcctccactgcggtcacgccgccagtggcgcagcaccacgaggcactggtcggccacgggtttacactttatgcttccggctcgtatgttgtgtgaaatatagcgcgcaaactagggataaattatctcaatccaaataatctgcaccggatctcgcccttacctgcagcaacaggagaagatcaaaccgaaggttaaggtcctggtgcctgacggcgagagcgacgacttggcaagtccgcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctctt

SEQ ID NO: 5044 - DNA, 494 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggcccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgaccgactttgggccaagttccggcgcaaccctgaagaattacaggtacacacactcgtgccggtaaatcttcatacaatcgttattcacttaccaaatgcccggatgaaaccaaccacggatgcgtcaggtttccgagcttcttctatcagcattgtgcagtactgcactgccttgttcattttgttagccttggccccgtgctggctcttgggccactgaa

SEQ ID NO: 5045 - DNA, 538 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgtccagcgcctgcttgccaccgccattgctggcgatggccaccacctgctggggaggtcctggtgcctgacggcgagagcgacgacttggcaagtccggcgcaacctgaagaattacaggtacacacactcgtgccggtaaatcttcatacaatcgttattcacttaccaaatgccggatgaaaccaccacggatgcgtcaggtttcgagcttcttctatcagcattgtgcagtactgcaccctgccttgttcattttgttagccttggccccgtgctggctcttggggccactg

SEQ ID NO: 5046 - DNA, 486 bp, Artificial; identical to SEQ ID NO: 4476
  TaSBEIIa-D allele with mutations introduced by TALEN pair TaSBEIIa_T03

SEQ ID NO: 5047 - DNA, 560 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggtttgaaagcctcaacttgattcgcaacaaaaagatccgctctgatactccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 5048 - DNA, 542 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcattttgcaggcgccgtcctgagccgcgcggcctctccagcaataatggtggcaagcaggcgctggagacggtccagcggctgttgccggtgctgtgccaggcccacggcttgacccccccagcaggtggtggcaaggtcctggtgccctgacggcgagagcgacgacttggcaagtccggcgcaacctgaagaattacaggtacacacactcgtgccggtaaatcttcatacaatcgttattcacttaccaaatgcccggatgaaaccaaccacggatgcgtcaggtttcgagcttcttctatcagcattgtgcagtactgcactgccttgttca

SEQ ID NO: 5049 - DNA, 467 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgc

SEQ ID NO: 5050 - DNA, 484 bp, Artificial; identical to SEQ ID NO: 4383
  TaSBEIIa-D allele with mutations introduced by TALEN pair TaSBEIIa_T03

SEQ ID NO: 5051 - DNA, 477 bp, Artificial; identical to SEQ ID NO: 3435
  TaSBEIIa-D allele with mutations introduced by TALEN pair TaSBEIIa_T03

SEQ ID NO: 5052 - DNA, 460 bp, Artificial
  TaSBEIIa-D allele with mutations introduced by TALEN pair TaSBEIIa_T03
gagatagctggattaggcgatcgcagcttccttgaacctgtatttttttcccccgcaggacgggaatgcgtttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttag

SEQ ID NO: 5053 - DNA, 484 bp, Artificial; identical to SEQ ID NO: 4191
  TaSBEIIa-D allele with mutations introduced by TALEN pair TaSBEIIa_T03

SEQ ID NO: 5054 - DNA, 486 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcactttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 5055 - DNA, 485 bp, Artificial; identical to SEQ ID NO: 4634
  TaSBEIIa-D allele with mutations introduced by TALEN pair TaSBEIIa_T03

SEQ ID NO: 5056 - DNA, 477 bp, Artificial
  TaSBEIIa-D allele with mutations introduced by TALEN pair TaSBEIIa_T03
  misc_feature (410): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagttgccgccatcgtggctggcgatggccaccacctgctccggggtcaagttgagaaggtcctggtgcctgacggcgagagcgacgacttggcaagtccggcgcaacctgaagaattacaggtacacacactcgtgccggtaaatcttcatacaatcgtattcacttnccaatgccggatgaaaccaaccacggtgcgtcaggtttcgagcttcttctatcagcattgtgcagta

SEQ ID NO: 5057 - DNA, 560 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccgatgttcttctctattgcggttgaaagcctcaacttgattcgcaacaaaaagaatccgctctgatactccgtgggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 5058 - DNA, 484 bp, Artificial; identical to SEQ ID NO: 4383
  TaSBEIIa-D allele with mutations introduced by TALEN pair TaSBEIIa_T03

SEQ ID NO: 5059 - DNA, 483 bp, Artificial; identical to SEQ ID NO: 4852
  TaSBEIIa-D allele with mutations introduced by TALEN pair TaSBEIIa_T03

SEQ ID NO: 5060 - DNA, 472 bp, Artificial; identical to SEQ ID NO: 4320
  TaSBEIIa-D allele with mutations introduced by TALEN pair TaSBEIIa_T03

SEQ ID NO: 5061 - DNA, 526 bp, Artificial; identical to SEQ ID NO: 4549
  TaSBEIIa-D allele with mutations introduced by TALEN pair TaSBEIIa_T03

SEQ ID NO: 5062 - DNA, 483 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttctgctgtaactgcaagttgtggcgttttttcactattgtagtcatccttgcattttgcaggcgccgtcctgagccgcgcggcctctccatcctggtgcctgacggcgagagcgacgacttggcaagtccggcgcaacctgaagaatttacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 5063 - DNA, 542 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaacaggaaggcaaatgccgcaaaagcaggtcctggtgcctgacggcgagagcgacgacttggcaagtccggcgcaacctgaagaattacaggtacacacactcgtgccggtaaatcttcatacatcgttattcacttaccaaatgccggatgaaaccaaccacggatgcgtcaggtttcgagcttcttctatcagca

SEQ ID NO: 5064 - DNA, 484 bp, Artificial; identical to SEQ ID NO: 3242
  TaSBEIIa-D allele with mutations introduced by TALEN pair TaSBEIIa_T03

SEQ ID NO: 5065 - DNA, 484 bp, Artificial
  TaSBEIIa-D allele with mutations introduced by TALEN pair TaSBEIIa_T03
gagatagctggattaggcgatcgcgcttcctgaacctgtatttttttccccgcgggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctcccctggtgcctgacggcgagagcgacgacttggcaagtccggcgcaacctgaagaattacaggtacacacactcgtgccggtaaatcttcatacaatcgttattcacttaccaaaatgcccggatgaaaccaaccacggatgcgtcaggtttcgagcttcttctatcagcattgtgcagtactgcactgcccttgttcattttgttagccttggccccgtgctggctcttgggccactgaa

SEQ ID NO: 5066 - DNA, 487 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 5067 - DNA, 547 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgtttttttcactattgtagtcatccttgcattttgcaggcgccgtcctgagccgcgcggcctctccatacgtttggaactgacagaaccgcaacgttgaaggagccactcagccgcgggtttctggagttaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactg

SEQ ID NO: 5068 - DNA, 613 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagaaggatcttaccgctgttgagatccagttcgatgtaacccactcgtgcacccaactgatcttcagcatcttttactttcaccagcgtttctgggtgagcaaaaacaggaaggcaaatgccgcaaaaagcaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggcactg

SEQ ID NO: 5069 - DNA, 486 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgacttggcaagtccggcgcaacctgaagaattacaggtacacacactcgtgccggtaaatcttcatacaatcgttattcacttaccaaaatgcccggatgaaaccaaccacggatgcgtcaggtttcgagcttcttctatcagcattgtgcagtactgcactgccttgttcatttttgttagccttggccccgtgctggctcttgggccactgaa

SEQ ID NO: 5070 - DNA, 478 bp, Artificial
  TaSBEIIa-D allele with mutations introduced by TALEN pair TaSBEIIa_T03
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtcctggtgcctgacggcgagagcgacgactttggcaagtccggcgcaacctgaagaattacaggtacacacactcgtgccggtaaatcttcatacaatcgttattcactttaccaaaatgcccgggatgaaaccaaccacggatgcgtcaggtttcgagcttcttctatcagcattgtgcagtactgcactgccttgttcatttttgttagccttggccccgtgctggctctt

SEQ ID NO: 5071 - DNA, 561 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggtagctcttgatccggcaaacaaaccaccgcgccttgcagcacatccccctttcgccagctggcgtaatagcgaaaggtcctggtgcctgacggcgagagcgacgacttggcaagtccggcgcaacctgaagaattacaggtacacacactcgtgccggtaaatcttcatacaatcgttattcacttaccaaatgccggtgaaaccaaccacggatgcgtcaggtttcgagcttcttctatcagcattgtgcagtactgcactgccttgttcatttttgttagccttggccccgtgctggctcttgggccactgaa

SEQ ID NO: 5072 - DNA, 473 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctgtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcatttttgttagccttggccccgtgctggctcttgggccactgaa

SEQ ID NO: 5073 - DNA, 480 bp, Artificial
  TaSBEIIa-D allele with mutations introduced by TALEN pair TaSBEIIa_T03
gagatagctggattaggcgatcgcgcttccatgaacctgtatttttttccccgcggggaaatgcgttagtgtcacccaggccctggtgttaccacggctttgatcattcctcgtttcattctgatatatattttctcactctttttcttccgttcttgctgtaactgcaagttgtggcgttttttcactattgtagtcatccttgcattttgcaggcgccgtcctgagccgcgcggcctcttcctggtgcctgacggcgagagcgacgacttggcaagtccggcgcaacctgaagaattacaggtacacacactcgtgccggtaaatcttcatacaatcgttattcacttaccaaatgccggatgaaaccaaccatggatgcgtcaggtttcgagcttcttctatcagcattgtgcagtactgcactgccttgttcatttttgttagccttggccccgtgctggctcttgggccactgaa

SEQ ID NO: 5074 - DNA, 438 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggtgccgtcctgagccgcgcggcctctcaggtcctggtgcctgacggcgagagcgacgacttggcaagtccggcgcaacctgaagaattacaggtacacacactcgtgccggtaaatcttcatacaatcgttattcactttaccaaaatgcccggatgaaaccaacccacggatgcgtcaggtttcgagcttcttctatcagcattgtgcagtactgcactgcc

SEQ ID NO: 5075 - DNA, 615 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaggcgcgcaaactaggataaattatcgcgccgcgatagaaaacaaaatatagcgcgcaaactaggataaattatcgctgctctgatgccgcatagttaagccagccccgacacccgccaacacccgctgaaggtcctggtgcctgacggcgagagcgacgacttgggcaaagtccggcgcaacctgaagaattacaggtacacacactcgtgccggtaaatcttcatacaatcgttattcacttccaaatgccggatgaaaccaaccacggatgcgtcaggtttcgagcttcttctatcagcattgtgcagtactgcactgccttgttcattttgttagccttggccccgtgctggctcttgggccactgaa

SEQ ID NO: 5076 - DNA, 449 bp, Artificial
  TaSBEIIa-D allele with mutations introduced by TALEN pair TaSBEIIa_T03
  misc_feature (274): n is a or c or t or g
gagatagctggattaggcgatcgcgcttcctgaacctgtattttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccggcgagagcgacgacttggcaagtccggcgcaacctgaagaattncaggtacacacactcgtgccggtaaatcttcatacaatcggttattcacttaccaaatgccggataaccaaccacggatgcgtcaggtttcgagcttcttctatcaagcattgtgcagtactgcactgccttgttcattttgttagccttggccccgtgctggctctggccactg

SEQ ID NO: 5077 - DNA, 483 bp, Artificial; identical to SEQ ID NO: 3279
  TaSBEIIa-D allele with mutations introduced by TALEN pair TaSBEIIa_T03

SEQ ID NO: 5078 - DNA, 411 bp, Artificial
  TaSBEIIa-D allele with mutations introduced by TALEN pair TaSBEIIa_T03
gagatagctggattaggcgatcgcgcttcctgaacctgtatttttttccccgcggggaaagatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagcctgacggcgagagcgacgacttggcaagtccggcgcaacctgagaattacaggtacacacactcgtgccggtaatcttcatacaatcgttattcacttaccaaatgccggatgaaccaaccacggatgcgtcaggtttcgagcttcttctatcagcattgtgcagtactgcactgccttg

SEQ ID NO: 5079 - DNA, 620 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccaagcgcctgcttgccgccatcgtggctggcgatggccaccacctgctccggggtcaagccgtgggcctggcacagcaccggcaacagccgctgggatcttcacctagatccttttaaattaaaaatgaagttttaaatcaatctaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggttttcgagcttcttctatcagcattgtgcagtactgcactgccttgttcatttttgttagccttggccccgtgctggctctt

SEQ ID NO: 5080 - DNA, 478 bp, Artificial
  TaSBEIIa-D allele with mutations introduced by TALEN pair TaSBEIIa_T03
gagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttgcttgctgtaactgcaagttgtggcgttttttcactattgtagtcatccttgcattttgcaggcgccgtcctgagccgcgcggcctctccaaaggtcctggtgcctgacggcgagagcgacgacttggcaagtccggcgcaacctgaagaattacaggtacacacactcgtgccggtaaatcttcatacaatcgttattcacttaccaaaatgccggatgaaaccaaccacggatgcgtcaggtttcgagcttcttctatcagcattgtgcagtactgcactgccttgtgcatttttgttagccgtggccccgtgctggctctt

SEQ ID NO: 5081 - DNA, 10586 bp, Triticum aestivum
  SBEIIa-B from Triticum aestivum Chinese Spring
  misc_feature (3699)..(3798): n is a or c or t or g
gttggtttgcgatcccgtcctccctcccgtcccctacgcaacgtcgcctccaccgtccatccgtcgctgccacctctgtgcgcgcgcacgagggaggaagacgacgcagcacacacactctccccgtgggtcccctttccggcttggcgtctatctcctctcccccccatccccatgcactgcacagtacccgccagcttccacccccgccgcacacgttgctcccccttctcatcgcttctcaattaatatctccatcactcgggttccgcgctgcatttcggccggcgggttgagtgagatctgggccactgaccgactcactcgctgcgcggggatggcgacgttcgcggtgtccggcgcgaccctcggtgtggcgcggcccgccagcgccggcggcggactgctgcgatccggctcggagcggaggggcggggtggacttgccgtcgctgctcctcaggaagaaggactcctctcgtacgcctcgctccctccaatctccccgtctgtttttgggcccccttctctctccctcgcctctctgcgcgcgcatggcctgttcgatgctgttccccagttgatctccatgaacgagagagatagctggattaggcgatcgcctcaggccctggtgttaccacggctttgatcatctcctcctttcatgctgatattttctcactctttcttctgttcttgctgtaactgcaagttgtagcatttttttggcgaataagttgtagcattgtctcactattgtactcatccttgcatttgcaggcgccgtcctgagccgcgcggcctctccagggaaggtcctggtgcctgacggtgagagcgacgacttggcggccactccagcgcaacccgaagaattacaggtacacaccgtcgtgccggaaaatcttcatgcacccgttattcacttaccaaatatcggatgaaccaagccgcggaggcatcaggtttcaagcttcttctatcagcattgtgcactacttcactgccttgtgcagtttgttagctgtggccccgcgctggctcttgggccactgaaaactcagatggatgtgcattctagcaagaacttcacaaaataatgcactgtttgtggtttcgttagtctgctctacaattgctatttttcgtgtgctgtagatacctgaagatatcgaggagcaaacggctgaagtgaacatgacaggggggactgcagagaaacttcaatattcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactgtttcatacagttcccctcatggtctgagaatatgctgggaagtatatgtataattgctggctacaattggctcataattgcaatacaaataactgtctccgatcattacaattacagagtggcaaactgatgaaaatgtggtggatgggttatggattttactttgctaattcctctaccaaattcctggggaaaaaatctaccagttgggcaacttagtttcttatctttgttgcctttttgttttggggaaaacacactgctaaatttgaatgattttgggtatgccttggtggattcaacagatacagcgaatacaagagaattcgtgctgctattgaccaacatgaaggtggattggaagcattttctcgtggttatgaaaagcttggatttacccgcaggtaaatttaaagctttactatgaaacgcctccactagtctaattgcatatcttgtaagaaaatttataattcctgttttcccctctcttttttccagtgctgaaggtatcatctaattgcttatcttataagaaaatttataattcctgtttccccccctctttttccagtgctgaaggtatcacttaccgagaatgggctcctggagcgcatgtacgtcttaacagacaccttctaatctattgttaatggtcactattcaccaactagcttactgaacttacaaaatagcttactgaatactgaccagttactctaaatttatgatctggcttttgcatcctgttacagtctgcagcattagtaggtgacttcaacaattggaatccaaatgcagatactatgaccagagtatgtctacagcttggcaatcttccacctttgcttcgtaactactgatacatctatttgtatttatttaactgtttgcacgttcgttaaagttgagcctcaactatatcataccaaaatggtataatttgtcagtgtcttaagcttcagcctaaagatcctactgaatttagtccatccttttgagattgaaaatgagtatattaagggtgattgaatacttgcaacactcccattttttggtagaaccttttgcattatgtgtgcttttccatccacaatgagcatatttccatgttatcagtgaaggtttgctcctattgatgccgatatttgatatgatctttcgatcttttcaggatgattatggtgtttgggagatcttcctccctaacaatgctgatggatccccagctattcctcatggctcacgtgtaaaggtaatctggccaattatttagtcgaggatgtaacattttcgaactctgcctactaagggtcccttttcctctctattttctagatacggatggatactccatctggtgtgaaggattcgatttctgcttggatcaagttctctgtgcaggctccaggtgaaataccattcaatggcatatattatgatccacctgaagaggtaagtatcaatctatgttacattattaaatggaatttccagtgttacagttttttgatacccacttcatgtctcactgacatgtgagtcaagacaatactttcgaatttggaagtgacatatgcattaattcaccttctaagggctaaggggcaaccaaccatggtgatgtgtgtatgcttgtgtgacttaagatcttatagctcttttatatgttctctgttggttaggacattccattttgaccttttgtgaccatttactaaggatattttacatgcaaatgcaggagaagtatgtcttccaacatcctcaacctaaacgaccagagtcactaaggatttatgaatcacacattggaatgagcagcccggtatgtcaataagttatttcacctgtttccggtctgatggtttattctatggattttctagttctgttatgtactgttaacataccacacggtgcattcacgtgacaacctcgattttattttctaatgtcttcatattggaaaatgcacaactttgcttcctctttgtctgatcgtttttttgtctctaagatttccattgcatttcgaggtagcgggcatgtgaaagtcgaatctgaatattttttgtcagagcacagttatattaaatgccattgttgttgcaatagcttggtataatgtagccatgttactagcttaagaaatatcgcattggagcatctccagcaagccatttcctaccttattactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaatattttagcgtgatcttgcacaggaaccgaagataaattcatatgctaattttagggatgaggtgctgccaagaattaaaaggcttggatacaatgcagtgcagataatggcaatccaggagcattcatactatgcaagctttgggtattcatacagtccatctttttctgttttttttttctgtatgtgcctcttcacccatttcgagccattacatcctaatgcttcgtgcacataaaatacttggatataattctttattagacatatagtacaacaccacttagtatttctgacttgtatgatcattttattgttgttggcttgttacaggtaccatgttactaatttttttgcaccaagtagccgttttggaactccagaggacttaaaatccttgatcgatagagcacatgagcttggtttgcttgttcttatggatattgttcataggtaatcagtccaatttaattttagttgctttactgtttatctggtattgtaaatggcagggccctatcgtcgaatatttttccaatctatataattgtgctacatgacttattttttctcagatgtattaaaccagttggatattaaatgtatttggtacatctagtaaactgacagtttcatagaattgtgttgtaatggcaacacaatttgatggcatagatgtggactgagaagttcagatgctatcagtaattaattaactggccatgtactcgtggaactacatagagtttgcaagttggaaaactgacagcaatacctcactgataagtgtccaggccacacttgccagcttcatattagatgttacttccctgttgaactcctttgaacatatcacttaaagttcttcaattgtcctaagtcaaacttctttgactttggccaagtctattgaaaaatatgtcaacatctacagcaccaaattagtttcataatttttattttgttatattagcacgttttttatgctgtagatatcagcacatttttctatagacttggtcaaatatagagaagtttgacttaggacaaatcagaacttcaagcaatttggatcagagggaatagtccatactgcttgattatattttcccaaaggagggagtgaggagcttgacttcggtatcatcaaatgatattgatagatgtcaacattttaacaaaaaatcagaccttgtcaccaaatatgcatcagaccatctgtttgcttaggcacttgctttcatatttatgtgtttgtaactaatctacttttccttctacttggtttgattgattctatttcagttgcattgcttcatcaatgattttgtgtaccctgcagtcattcgtcaaataatacccttgacggtttgaatggtttcgatggcactgatacacattacttccacggtggtccacgtggccatcattggatgtgggattctcgtctgttcaactatgggagttgggaagtatgtagctgcgacttctgtcaccatgtttggctaactgttcctgccaatctgttcttacacgtgtcaatattctattcttatacaggtattaagattcttactgtcaaacgcgagatggtggcttgaagaatataagtttgatggatttcgatttgatggggtgacctccatgatgtatactcaccatggattacaagtaagtcatcaagtggtttcagtaacttcttcagggcactgaaacaattgctatgcatcataacatgtatcatgatcagtacttatgctacggagtcttagatagttccctagtatgcttgtacaattttacctgatgagatcatggaagattggaagtgattgttattatttttccttctaagtttgcttcttgttctagatgacatttactgggaactatggcgagtattttggatttgccactgatgttgatgcggtggtatacttaatgctggtcaacgatctaattcatggactttatcctgatgctgtatccattggtgaagatgtaagtgcttacagtatttatgttttttaaccagttaatttaatagtattttattttggggatcaagctgttactactctttttgttagggtaaaatctgtcttttcataagaatgctaatttatactccctccgtctggaaatacttgtcggaggaatgaatgtatctagacgtattttagttctagatacatccatttttatgcatttctccgtcaagtatttccggacggagggagtaccttgtatggtaatgcatcacataggtaatttgagaagtgcaagggcattcaagctgacaagcatatttgttgatggctgtaatttatttgatagtatgcttgtttggatttttcagtaagtgtgagtgtgtgagtaatgttatattatttatttacttgcggaagaaatgggcaaccttgtcaattgcttcagaagactaacttagattccataaatgctgtggaaatgagaggctattcccaaggacacgaaattatacgtcagtgtgttacgcacatgtatttgtaagagcaagagcaacatggtttaacttaaattcctgcactgctatggaatctcactgtatgttgttagtgtacgcatccacaaacaagtaatcctgagctttcaactcacgagaaaataggaggctccacttctgccagcattagctgttcacagttctaatttgtgtaactctgaaattgttcaggtcagtggaatgcctacattttgcatccctgttccagatggtggtgttggttttgactatcgcctgcatatggctgtagcagataaatggatcgaactcctcaagtaagtgcaggaatattggtgattacatgcgcacaatgatctactccctctgtcccataatgtaagatgttttttgacactagtgtagtgtcaaaaaacgtcctatattatgggaaggagggagtagttcacaatttctaaattgtaaaaagaaaaatatgtatgtgaatagctagacatttccctggtatcagcttcaacacaagaagatttatcaaatacatgatttaaatagcaaatttcggaaatgtaatggctagtgtctttatgctggatattgtacatggcgctgtagcaggtgagtcaataaagctagcgatattttcagaaacaaaataatcatttatatctgtatatggggaaagtgggggtatagatggtggtcattaatcgtgttcactttttgtcctgtataagcacaggcagtaggtaataaatttagccagataaaataaatcgttattaggtttacaaaaggaatacagagggtcatgtagcatatctagttgtagttattgtaaaggctgacaagaggttcagtaaaaaaaactttatgttgatcccgggtatgcaagaacgcgagtaaagctcaaacatttatagtggttgctgttgcttgctgtatacttgtatctgcgcatatatgaaattactactacacagctgccaatctgccatgatctgtgttttgctttgtgctatttaaattttaaatgctaactcaataaatggcaataataaactaactattcaaccaatttgatggatatcagagatttcttccctcctttagtaacattgtgctcctgctgctgttctctaccgttacaaaagctgtttttccatttttcgcatcattatttttgtgtgtgagtaatttaagcatgtcctttgaagctgtgagctgttggtacttagtacattcttggtagtgtccaaatatgctgcagtctaatttagcatttctataacacaggcaaagtgacgaatcttggaaaatgggcgatattgtgcacaccctaacaaatagaaggtggcttgagaagtgcgtcacttatgcagaaagtcatgatcaagcactagttggtgacaagactattgcattctggttgatggataaggtactagctgttacttttggatcaaaagaatcacataagatttgtctcatcagattgctcatgttttcttgtgataaagatttggccccctcacccatcaccagctatttcccaactgtcacttgagcaaaacgtgccatgtggcactgtggtggcttgtgaactttgacagttaatgttgcaaatttctgttcttatttatttgattcttatgttatcgttcatttattcctcaaaaaatgttatcgttcatttgctcattcctttccgagaccagccgaagtcacgtgtagccatgtgatctgccatctgaatcttgagcaaattttatgaagaggctaaagtcgaacggattatttgcttgaatttataaatatacagacgtataatcacctggtgctttctgaaatgattaccatagtgcctgaaggctgaaatagttttggcgtttcctggacgacgcccaaaggagtgaattttattgggtagatttctggctgagccctggttacaacatacattttggagatatgcttaataacaaatctgggtgtttggtcacgagtctgcatctacatgctccttgggttttattatggcgtcatctttgtaactagtggcacccctaaggaaacattcaaaaggaaactgttacatcattctagtcaggaccaccgtactaagagcaaaattctgttccaattttatgagtttttgagactccaaaatgaacataagtgtctcatattttgctaattaactacagatgtttttatatcactttagtttttatttcaggacagttgatacttggtactgtgctgtaagcattgatccgacacagaacagcatgaacatttcgagctctctttgtgcaggatatgtatgatttcatggctctggatagaccttcaactcctcgcattgatcgtggcatagcattacataaaatgatcaggcttgtcaccatgggtttaggtggcgaaggctatcttaacttcatgggaaatgagtttgggcatcctggtcagtctttacaacattattgcattctgcatggttgtgatttactgtaatttgaaccatgctttgttttcacattgtatgtattatgtaatctgttgcttccaaggaggaagttaacttctatttacttggcagaatggatagattttccaagaggtccgcaaactcttccaaccggcaaagttctccctggaaataacaatagttatgataaatgccgccgtagatttgatcttgtaagttttagctgtgctcttacgttccctcactagatctttattggctatttatttcttgatgaaatcataatgtttgttgatcaacattgcttttgtagttttgtagacgttaacataaatatgtgttaagagttattgatcattaagaatatcatgattttttttgtagggagatgcagattttcttagatatcgtggtatgcaagagttcgaccaggcaatgcagcatcttgaggaaaaatatggggtatgtcagtatgtcactggtttgtctttgttgcatagcaagtcacagtttaacgccagtctcttcaaatggtcaaaaagtgtagaattaattcctgtaatgagatgaaaactgcgcaaaggcgggagctggaattgcttttcaccaattaaaactattttcttaagcgattgtgtattgatacctataccaacactgacaatgtaactgcagtttatgacatctgagcaccagtatgtttcacggaaacatgaggaagataaggtgatcatcttcgaaagaggagatttggtatttgttttcaacttccactggagcaatagcttttttgactaccgtgttgggtgttccaagcctgggaagtacaaggtatgcttgccttttcattgcccacccttcaccagtagggttagtgggggcttctacaacttttaattccacatgtagagtttgttgttcgtgcagctatcaatataaagaataggataatttgtaaagaaaagaatttgttgctcgagatgttgtagtcatataacatccccgaagcacatctactattcattcatattatctacttaagggtttgttacaatctttgtactcagttggactcactctaatactggaactatttaccgaatctaccctaatcatcctagcagttttagagcagccccatttggacagtccactgggtttagttggtttgtgacagtttctgctatttcttaatcaggtggccttagactccgacgatgcactctttggtggattcagcaggcttgatcatgatgtcgactacttcacaaccgtaagtctgggctcaagcgtcacttgactcgtctagactcaactgcttacaaatctgaatcaacctcccatttgctgatgcccttgcaggaacatccgcatgacaataggccgcgctctttcttggtgtacactcctagcagaactgcggtcgtgtatgcccttacagagtaagaaccagcagcggcttgttacaaggcaaagagagaactccagggagctcgtggattgtgagcgaagcgacgggcaactgcgtgaggctgctctaagcgccatgactgggaggggatcgtgcctcttcccctgatgccaggaggatcagatggataggtagcttgttggtgagcgctcgaaagaaaatggacgggcctgggtgtttgtcgtgctgcacttaaccctcctcctatgttgcacattcccgggtgtttttgtacatataactaataattgcccgtgcgcttcaacatgaacatataaatattctatataataggttatcccgtgatttacctgccgata

SEQ ID NO: 5082 - DNA, 10518 bp, Triticum aestivum
  SBEIIa-D from Tritucm aestivum Chinese Spring
  misc_feature (3504)..(3603): n is a or c or t or g
cagcgtcgcctccaccgtccgtccgtcgctctctgccacctctgctgtgcgcgcgcacgagggaggaagacgacgccgcacacacactcacacacggcacactccccgtgggtcccctttccggctcggcgtctatctcctctcccccgcccatccccatgcactgcaccgtacccgccagcttccacccccgccgcacacgttgctcccccttctcatcgcttctcaattaatatctccatcactcgggttccgcgctgcatttcggccggcgggttgagtgagatctgggcgactggctgactcaatcactacgcggggatggcgacgttcgcggtgtccggcgcgactctcggtgtggcgcgggccggcgtcggagtggcgcgggccggctcggagcggaggggcggggcggacttgccgtcgctgctcctcaggaagaaggactcctctcgtacgcctcgctctctcgaatctccccgtctggctttggctccccttctctctcctctgcgcgcgcatggcctgttcgatgctgttccccaattgatctccatgagtgagagagatagctggattaggcgatcgcgcttcctgaacctgtatttttttccccgcggggaaatgcgttagtgtcacccaggccctggtgttaccacggctttgatcattcctcgtttcattctgatatatattttctcactctttttcttcctgttcttgctgtaactgcaagttgtggcgttttttcactattgtagtcatccttgcattttgcaggcgccgtcctgagccgcgcggcctctccagggaaggtcctggtgcctgacggcgagagcgacgacttggcaagtccggcgcaacctgaagaattacaggtacacacactcgtgccggtaaatcttcatacaatcgttattcacttaccaaatgccggatgaaaccaaccacggatgcgtcaggtttcgagcttcttctatcagcattgtgcagtactgcactgccttgttcattttgttagccttggccccgtgctggctcttgggccactgaaaaaatcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctgggaagtaaatgtataattgatggctacaatttgctcaaaattgcaatacgaataactgtctccgatcattacaattaaagagtggcaaactgatgaaaatgtggtggatgggttatagattttactttgctaattcctctaccaaattcctaggggggaaatctaccagttgggaaacttagtttcttatctttgtggcctttttgttttggggaaaacacattgctaaattcgaatgattttgggtatacctcggtggattcaacagatacagcgaatacaagagaattcgtgctgctattgaccaacatgaaggtggattggaagcattttctcgtggttatgaaaagcttggatttacccgcaggtaaatttaaagctttattattatgaaacgcctccactagtctaattgcatatcttataagaaaatttataattcctgttttcccctctcttttttccagtgctgaaggtatcgtctaattgcatatcttataagaaaatttatattcctgttttcccctattttccagtgctgaaggtatcacttaccgagaatgggctcctggagcgcatgtatgtcttttaagtcttaacagacaccttccaatttattgttaatggtcactattcaccaactagcttactggacttacaaattagcttactgaatactgaccagttactataaatttatgatctggcttttgcaccctgttacagtctgcagcattagtaggtgacttcaacaattggaatccaaatgcagatgctatgaccagagtatgtctacagcttggcaattttccacctttgcttcataactactgatacatctatttgtatttatttagctgtttgcacattccttaaagttgagcctcaactacatcatatcaaaatggtataatttgtcagtgtcttaagcttcagcccaaagattctactgaatttagtccatctttttgagattgaaaatgagtatattaaggatgaatgaatacgtgcaacactcccatctgcattatgtgtgcttttccatctacaatgagcatatttccatgctatcagtgaaggtttgctcctattgatgcagatatttgatatggtcttttcaggatgattatggtgtttgggagattttcctccctaacaacgctgatggatcctcagctattcctcatggctcacgtgtaaaggtaagctggccaattatttagtcgaggatgtagcattttcgaactctgcctactaagggtcccttttcctctctgttttttagatacggatggatactccatccggtgtgaaggattcaatttctgcttggatcaagttctctgtgcaggctccaggtgaaatacctttcaatggcatatattatgatccacctgaagaggtaagtatcgatctacattacattattaaatgaaatttccagtgttacagttttttaatacccacttcttactgacatgtgagtcaagacaatacttttgaatttggaagtgacatatgcattaattcaccttctaagggctaaggggcaaccaaccttggtgatgtgtgtatgcttgtgtgtgacataagatcttatagctcttttatgtgttctctgttggttaggatattccattttggccttttgtgaccatttactaaggatatttacatgcaaatgcaggagaagtatgtcttccaacatcctcaacctaaacgaccagagtcactaaggatttatgaatcacacattggaatgagcagcccggtatgtcaataagttatttcacctgtttctggtctgatggtttattctatggattttctagttctgttatgtactgttaacatattacatggtgcattcacttgacaacctcgattttattttctaatgtcttcatattggcaagtgcaaaactttgcttcctctttgtctgcttgttcttttgtcttctgtaagatttccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggggggggggggggggtagcgttctgtattctgcgagcgattcaaaaacttccattgttctgaggtgtacgtactgcagggatctcccattatgaagaggatatagttaattctttgtaacctacttggaaacttgagtcttgaggcatcgctaatatatactatcatcacaatacttagaggatgcatctgaatattttagtgtgatcttgcacaggaaccgaagataaattcatatgctaattttagggatgaggtgttgccaagaattaaaaggcttggatacaatgcagtgcagataatggcaatccaggagcattcatactatgcaagctttgggtattcacacaatccatttttttctgtatacacctcttcacccatttggagctattacatcctaatgcttcatgcacataaaatatttggatataattctttattagatatatagtacaactacacttagtattctgacttttatgatcattttattgttgttggcttgttccaggtaccatgttactaatttttttgcaccaagtagccgttttggaactccagaggacttaaaatccttgatcgatagagcacatgagcttggtttgcttgttcttatggatattgttcataggtaattagtccaatttaattttagctgttttactgtttatctggtattctaaagggaaaatcaggcaattatgatacattgtcaaaagctaagagtggcgaaagtgaaatgtcaaaatctagagtggcataaggaaaattggcaaaaactagtggcaaaaataaaattttcccatcctaaatggcagggccctatcgccgaatatttttccattctatataattgtgctacgtgacttcttttttctcagatgtattaaaccagttggacatgaaatgtatttggtacatgtagtaaactgacagttccatagaatatcgttttgtaatggcaacacaatttgatgccatagatgtggattgagaagttcagatgctatcaatagaattaatcaactggccatgtactcgtggcactacatatagtttgcaagttggaaaactgacagcaatacctcactgataagtggccaggccccacttgccagcttcatactagatgttacttccctgttgaattcatttgaacatattacttaaagttcttcatttgtcctaagtcaaacttctttaagtttgaccaagtctattggaaaatatatcaacatctacaacaccaaattactttgatcagattaacaatttttattttattatattagcacatctttgatgttgtagatatcagcacatttttctatagacttggtcaaatatagagaagtttgacttaggacaaatctagaacttcaatcaatttggatcagagggaacatcaaataatatagatagatgtcaacacttcaacaaaaaaatcagaccttgtcaccatatatgcatcagaccatctgtttgctttagccacttgctttcatatttatgtgtttgtacctaatctacttttccttctacttggtttggttgattctatttcagttgcattgcttcatcaatgattttgtgtaccctgcagtcattcgtcaaataatacccttgacggtttgaatggtttcgatggcactgatacacattacttccacggtggtccacgcggccatcattggatgtgggattctcgtctattcaactatgggagttgggaagtatgtagctctgacttctgtcaccatatttggctaactgttcctgttaatctgttcttacacatgttgatattctattcttatgcaggtattgagattcttactgtcaaacgcgagatggtggcttgaagaatataagtttgatggatttcgatttgatggggtgacctccatgatgtatactcaccatggattacaagtaagtcatcaagtggtttcagtaacttttttagggcactgaaacaattgctatgcatcataacatgtatcatgatcaggacttgtgctacggagtcttagatagttccctagtatgcttgtacaattttacctgatgagatcatggaagattggaagtgattattatttattttctttctaagtttgtttcttgttctagatgacatttactgggaactatggcgaatattttggatttgctactgatgttgatgcggtagtttacttgatgctggtcaacgatctaattcatggactttatcctgatgctgtatccattggtgaagatgtaagtgcttacagtatttatgatttttaactagttaagtagttttattttggggatcagtctgttacactttttgttaggggtaaaatctctcttttcataacaatgctaatttataccttgtatgataatgcatcacttaggtaatttgaaaagtgcaagggcattcaagcttacgagcatattttttgatggctgtaatttatttgatagtatgcttgtttgggtttttcaataagtgggagtgtgtgactaatgttgtattatttatttaattgcggaagaaatgggcaaccttgtcaattgcttcagaaggctaactttgattccataaacgctttggaaatgagaggctattcccaaggacatgaattatacttcagtgtgttctgtacatgtatttgtaatagtggtttaacttaaattcctgcactgctatggaatctcactgtatgttgttagtgtacacatccacaaacaagtaatcctgaactttcaactcatgagaaaataggaggttccgcttctgccagcattaactgttcacagttctaatttgtgtaactgtgaaattgttcaggtcagtggaatgcctacattttgcatccctgttccagatggtggtgttggttttgactaccgcctgcatatggctgtagcagataaatggattgaactcctcaagtaagtgcaggaatattggtgattacatgcgcacaatgatctagattacattttctaaatggtaaaaaggaaaatatgtatgtgaatatctagacatttgcctgttatcagcttgaatacgagaagtcaaatacatgatttaaatagcaaatctcggaaatgtaatggctagtgtctttatgctgggcagtgtacattgcgctgtagcaggccagtcaacacagttagcaatattttcagaaacaatattatttatatccgtatatgaggaaagtaggtatataaactgtggtcattaattgtgttcaccttttgtcctgtttaaggatgggcagtaggtaataaatttagccagataaaataaatcgttattaggtttacaaaaggaatatacagggtcatgtagcatatctagttgtaattaatgaaaaggctgacaaaaggctcggtaaaaaaaactttatgatgatccagatagatatgcaggaacgcgactaaagctcaaatacttattgctactacacagctgccaatctgtcatgatctgtgttctgctttgtgctatttagatttaaatactaactcgatacattggcaataataaacttaactattcaaccaatttggtggataccagagatttctgccctcttgtagtaatgatgtgctcctgctgctgttctctgccgttacaaaagctgttttcagttttttgcatcattatttttgtgtgtgagtagtttaagcatgttttttgaagctgtgagctgttggtacttaatacattcttggaagtgtccaaatatgctgcagtgtaatttagcatttctttaacacaggcaaagtgacgaatcttggaaaatgggcgatattgtgcacaccctaacaaatagaaggtggcttgagaagtgtgtaacttatgcagaaagtcatgatcaagcactagttggtgacaagactattgcattctggttgatggataaggtactagctgttacttttggaccaaaagaattactccctccgttcctaaatataagtctttgtagagattccactatggaccacatagtatatagatgcattttagagtgtagattcactcattttgcttcgtatgtagtccatagtgaaatctctacagagacttatatttaggaacggagggagtacataattgatttgtctcatcagattgctagtgttttcttgtgataaagattggctgcctcacccatcaccagctatttcccaactgttacttgagcagaatttgctgaaaacgtaccatgtggtactgtggcggcttgtgaactttgacagttatgttgcaattttctgttcttatttatttgattgcttatgttaccgttcatttgctcatttctttccgagaccagccaaagtcacgtgtagctgtgtgatctgttatctgaatcttgagcaaattttattaataggctaaaatccaacgaattatttgcttgaatttaaatatacagacgtatagtcacctggctctttcttagatgattaccatagtgcctgaaggctgaaatagttttggtgtttcttggatgccgcctaaaggagtgatttttattggatagattcctggccgagtcctcgttacaacatacattttggagatatgcttagtaacagctctgggaagtttggtcacaagtctgcatctacacgctccttgaggttttattatggcgccatctttgtaactagtggcacctgtaaggaaacacattcaaaaggaaacggtcacatcattctaatcaggaccaccatactaagagcaagattctgttccaattttatgagtttttgggactccaaagggaacaaaagtgtctcatattgtgcttataactacagttgtttttataccagtgtagttttattccaggacagttgatacttggtactgtgctgtaaattatttatccgacatagaacagcatgaacatatcaagctctctttgtgcaggatatgtatgatttcatggctctggataggccttcaactcctcgcattgatcgtggcatagcattacataaaatgatcaggcttgtcaccatgggtttaggtggtgaaggctatcttaacttcatgggaaatgagtttgggcatcctggtcagtctttacaacattattgcattctgcatgattgtgatttactgtaatttgaaccatgcttttctttcacattgtatgtattatgtaatctgttgcttccaaggaggaagttaacttctatttacttggcagaatggatagattttccaagaggcccacaaactcttccaaccggcaaagttctccctggaaataacaatagttatgataaatgccgccgtagatttgatcttgtaagttttagctgtgctattacattccctcactagatctttattggccatttatttcttgatgaaatcataatgtttgttaggaaagatcaacattgcttttgtagttttgtagacgttaacataagtatgtgttgagagttgttgatcattaaaaatatcatgattttttgcagggagatgcagattttcttagatatcgtggtatgcaagagttcgatcaggcaatgcagcatcttgaggaaaaatatggggtatgtcactggtttgtctttgttgcataacaagtcacagtttaacgtcagtctcttcaagtggtaaaaaaagtgtagaattaattcctgtaatgagatgaaaactgtgcaaaggcggagctggaattgcttttcaccaaaactattttcttaagtgcttgtgtattgatacatataccagcactgacaatgtaactgcagtttatgacatctgagcaccagtatgtttcacggaaacatgaggaagataaggtgatcatcttcgaaagaggagatttggtatttgttttcaacttccactggagcaatagcttttttgactaccgtgttgggtgttccaagcctgggaagtacaaggtatgcttgccttttcattgtccacccttcaccagtagggttagtgggggcttctacaacttttaattccacatggatagagtttgttggtcgtgcagctatcaatataaagaatagggtaatttgtaaagaaaagaatttgctcgagctgttgtagccataggaaggttgttcttaacagccccgaagcacataccattcattcatattatctacttaagtgtttgtttcaatctttatgctcagttggactcggtctaatactagaactattttccgaatctaccctaaccatcctagcagttttagagcagccccatttggacaattggctgggtttttgttagttgtgacagtttctgctatttcttaatcaggtggccttggactccgacgatgcactctttggtggattcagcaggcttgatcatgatgtcgactacttcacaaccgtaagtctgggctcaagcgtcacttgactcgtcttgactcaactgcttacaaatctgaatcaacttcccaattgctgatgcccttgcaggaacatccgcatgacaacaggccgcgctctttctcggtgtacactccgagcagaactgcggtcgtgtatgcccttacagagtaagaaccagcagcggcttgttacaaggcaaagagagaactccagagagctcgtggatcgtgagcgaagcgacgggcaacggcgcgaggctgctccaagcgccatgactgggaggggatcgtgcctcttccccagatgccaggaggagcagatggataggtagcttgttggtgagcgctcgaaagaaaatggacgggcctgggtgtttgttgtgctgcactgaaccctcctcctatcttgcacattcccggttgtttttgtacatataactaataattgcccgtgcgcttcaacatgaacatataaatattctaataggttatcccgtgatttacctgcctat

SEQ ID NO: 5083 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 5084 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5085 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 5086 - DNA, 470 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 5087 - DNA, 469 bp, Artificial; identical to SEQ ID NO: 5084
  TaSBEIIa  allele with mutations introduced by TALEN pair TaSBEIIa_T01

SEQ ID NO: 5088 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5089 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5090 - DNA, 468 bp, Artificial; identical to SEQ ID NO: 5089
  TaSBEIIa  allele with mutations introduced by TALEN pair TaSBEIIa_T01

SEQ ID NO: 5091 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5092 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5093 - DNA, 468 bp, Artificial; identical to SEQ ID NO: 5089
  TaSBEIIa  allele with mutations introduced by TALEN pair TaSBEIIa_T01

SEQ ID NO: 5094 - DNA, 517 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctattttcggagccatcttgactaccggtaatgcctacccgctaatttcgctcattttgaattaaggtcctttcatcatgcaaatttggggaacatcaaagaggcaaagactagggaccactatttctactacgttaccctccatagtcgttcgaggaataattgcgtggacgtgagaactgccaacggacgacaccaaggggagtaagg

SEQ ID NO: 5095 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5096 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5097 - DNA, 467 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaaccagtcgcgggggagaaaccgcgagttgtcccaaaaccaggagatgggcagaaaatatacgagattgacccaaattttcggagccatcttgactaccggtaatgcctacccgctaatttcgctcattttgaattaaggtccttttcatcatgcaaatttgggaacatcaaagaggcaaagactagggaccactatttcatacagttcccctcatggtctgagaatatgctggga

SEQ ID NO: 5098 - DNA, 467 bp, Artificial; identical to SEQ ID NO: 5092
  TaSBEIIa  allele with mutations introduced by TALEN pair TaSBEIIa_T01

SEQ ID NO: 5099 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtccttttcgtcatgcaaatttggggaacatcaaagagacaaagactagggaccactatttcttacagttcccctcatggtctgagaatatgctggga

SEQ ID NO: 5100 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattcatacagatcccctcgtggtctgagaatatgctggga

SEQ ID NO: 5101 - DNA, 472 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 5102 - DNA, 466 bp, Artificial
  TaSBEIIa  allele with mutations introduced by TALEN pair TaSBEIIa_T01
  misc_feature (346): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaaattttcggagccatcttgactaccggtaatgcctacccgntaatttcgctcattttgaattaaggtcctttcatcatgcaaatttgggaacatcaaagaggcaaagactagggaccactatttcatacagttcccctcatggtctgagaatatgctggga

SEQ ID NO: 5103 - DNA, 498 bp, Artificial
  TaSBEIIa  allele with mutations introduced by TALEN pair TaSBEIIa_T01
  misc_feature (470); (495): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctgggaangtagcctagcaagcaggactagggntag

SEQ ID NO: 5104 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgttttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5105 - DNA, 464 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5106 - DNA, 443 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5107 - DNA, 467 bp, Artificial; identical to SEQ ID NO: 5092
  TaSBEIIa  allele with mutations introduced by TALEN pair TaSBEIIa_T01

SEQ ID NO: 5108 - DNA, 471 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 5109 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 5110 - DNA, 443 bp, Artificial; identical to SEQ ID NO: 5106
  TaSBEIIa  allele with mutations introduced by TALEN pair TaSBEIIa_T01

SEQ ID NO: 5111 - DNA, 464 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttggggaacatcaaagagacaaagactgggaccactatttcttacagttcccctcatggtctgagaatatgctggga

SEQ ID NO: 5112 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5113 - DNA, 468 bp, Artificial; identical to SEQ ID NO: 5089
  TaSBEIIa  allele with mutations introduced by TALEN pair TaSBEIIa_T01

SEQ ID NO: 5114 - DNA, 469 bp, Artificial; identical to SEQ ID NO: 5084
  TaSBEIIa  allele with mutations introduced by TALEN pair TaSBEIIa_T01

SEQ ID NO: 5115 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 5116 - DNA, 469 bp, Artificial; identical to SEQ ID NO: 5084
  TaSBEIIa  allele with mutations introduced by TALEN pair TaSBEIIa_T01

SEQ ID NO: 5117 - DNA, 470 bp, Artificial
  TaSBEIIa  allele with mutations introduced by TALEN pair TaSBEIIa_T01
  misc_feature (447): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttccccctnatggtctgagaatatgcgtggga

SEQ ID NO: 5118 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 5119 - DNA, 473 bp, Artificial
  TaSBEIIa  allele with mutations introduced by TALEN pair TaSBEIIa_T01
  misc_feature (409); (449): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaattttggggaacatcaaaagngacaaagactagggaccactatttcttacagttccccctnatggtctgagaatatcgcgtggga

SEQ ID NO: 5120 - DNA, 469 bp, Artificial; identical to SEQ ID NO: 5084
  TaSBEIIa  allele with mutations introduced by TALEN pair TaSBEIIa_T01

SEQ ID NO: 5121 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatagctggga

SEQ ID NO: 5122 - DNA, 469 bp, Artificial; identical to SEQ ID NO: 5084
  TaSBEIIa  allele with mutations introduced by TALEN pair TaSBEIIa_T01

SEQ ID NO: 5123 - DNA, 471 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 5124 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5125 - DNA, 469 bp, Artificial; identical to SEQ ID NO: 5084
  TaSBEIIa  allele with mutations introduced by TALEN pair TaSBEIIa_T01

SEQ ID NO: 5126 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5127 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgttttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5128 - DNA, 469 bp, Artificial; identical to SEQ ID NO: 5118
  TaSBEIIa  allele with mutations introduced by TALEN pair TaSBEIIa_T01

SEQ ID NO: 5129 - DNA, 470 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgcttttcggagccatcttgactaccggtaatcgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 5130 - DNA, 467 bp, Artificial; identical to SEQ ID NO: 5092
  TaSBEIIa  allele with mutations introduced by TALEN pair TaSBEIIa_T01

SEQ ID NO: 5131 - DNA, 464 bp, Artificial; identical to SEQ ID NO: 5105
  TaSBEIIa  allele with mutations introduced by TALEN pair TaSBEIIa_T01

SEQ ID NO: 5132 - DNA, 469 bp, Artificial; identical to SEQ ID NO: 5088
  TaSBEIIa  allele with mutations introduced by TALEN pair TaSBEIIa_T01

SEQ ID NO: 5133 - DNA, 467 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctttcggagccatcttgactaccggtaatgcctaccgctaatttcgctcattttgaattaaggtcctttcatcatgcaaatttggggaacatcaaagaggcaaagactagggaccactatttcatacagttcccctcatggtctgagaatatgctggga

SEQ ID NO: 5134 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5135 - DNA, 474 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatacaaagaggacaaagactagggaccactatttcatacagttcccctcatggtctgagaatatgctggga

SEQ ID NO: 5136 - DNA, 465 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5137 - DNA, 468 bp, Artificial; identical to SEQ ID NO: 5091
  TaSBEIIa  allele with mutations introduced by TALEN pair TaSBEIIa_T01

SEQ ID NO: 5138 - DNA, 467 bp, Artificial; identical to SEQ ID NO: 5092
  TaSBEIIa  allele with mutations introduced by TALEN pair TaSBEIIa_T01

SEQ ID NO: 5139 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcatttgaattaaggtccttcgtcatgcaaatttggggaacatcaaagagacaaagactagggaccactatttcttacagttcccctcatggtctgagaatatgctggga

SEQ ID NO: 5140 - DNA, 470 bp, Artificial; identical to SEQ ID NO: 5112
  TaSBEIIa  allele with mutations introduced by TALEN pair TaSBEIIa_T01

SEQ ID NO: 5141 - DNA, 468 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 5142 - DNA, 469 bp, Artificial; identical to SEQ ID NO: 5084
  TaSBEIIa  allele with mutations introduced by TALEN pair TaSBEIIa_T01

SEQ ID NO: 5143 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 5144 - DNA, 468 bp, Artificial; identical to SEQ ID NO: 5091
  TaSBEIIa  allele with mutations introduced by TALEN pair TaSBEIIa_T01

SEQ ID NO: 5145 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5146 - DNA, 468 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgcttttcggagccatcttgactaccggtaatgcctaccgctaatttcgctcattttgaattaaggtcctttcatcatgcaaatttggggaacatcaaagaggcaaagactagggaccactatttcatacagttcccctcatggtctgagaatatgctggga

SEQ ID NO: 5147 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5148 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5149 - DNA, 470 bp, Artificial
  TaSBEIIa  allele with mutations introduced by TALEN pair TaSBEIIa_T01
tcagatggatgtgcagttctagcaagaacttcacgaaataatgcgactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5150 - DNA, 443 bp, Artificial; identical to SEQ ID NO: 5106
  TaSBEIIa  allele with mutations introduced by TALEN pair TaSBEIIa_T01

SEQ ID NO: 5151 - DNA, 469 bp, Artificial; identical to SEQ ID NO: 5124
  TaSBEIIa  allele with mutations introduced by TALEN pair TaSBEIIa_T01

SEQ ID NO: 5152 - DNA, 468 bp, Artificial; identical to SEQ ID NO: 5089
  TaSBEIIa  allele with mutations introduced by TALEN pair TaSBEIIa_T01

SEQ ID NO: 5153 - DNA, 465 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtccttcatcatgcaaatttggggaacatcaaagagacaaagactagggaccaccatttcatacagatcccctcgtggtctgagaatatgctggga

SEQ ID NO: 5154 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgtttcggagccatcttgactaccggtaatgcctacccgctgctttcgctcattttgaaattaaggtcctttcatcatgcaaatttggggaacatcaaagagacaaagactagggaccaccatttcatacagatcccctcgtggtctgagaatatgctggga

SEQ ID NO: 5155 - DNA, 464 bp, Artificial; identical to SEQ ID NO: 5105
  TaSBEIIa  allele with mutations introduced by TALEN pair TaSBEIIa_T01

SEQ ID NO: 5156 - DNA, 467 bp, Artificial; identical to SEQ ID NO: 5085
  TaSBEIIa  allele with mutations introduced by TALEN pair TaSBEIIa_T01

SEQ ID NO: 5157 - DNA, 468 bp, Artificial
  TaSBEIIa  allele with mutations introduced by TALEN pair TaSBEIIa_T01
tcagatgatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5158 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgatttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 5159 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcatttgaattaaggtcctttcgtcatgcaaatttgggaacatcaaagagacaaagactagggaccactatttcttacagttccctcatggtctgagaatatgctggga

SEQ ID NO: 5160 - DNA, 471 bp, Artificial; identical to SEQ ID NO: 5123
  TaSBEIIa  allele with mutations introduced by TALEN pair TaSBEIIa_T01

SEQ ID NO: 5161 - DNA, 467 bp, Artificial; identical to SEQ ID NO: 5092
  TaSBEIIa  allele with mutations introduced by TALEN pair TaSBEIIa_T01

SEQ ID NO: 5162 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctagttttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 5163 - DNA, 460 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgccatcttgactaccggtaatgcctacccgctaatttcgctcattttgaattaaggtcctttcatcatgcaaatttgggaacatcaaagaggcaaagactagggaccactattcatacagttcccctcatggtctgagaatatgctggga

SEQ ID NO: 5164 - DNA, 470 bp, Artificial; identical to SEQ ID NO: 5112
  TaSBEIIa  allele with mutations introduced by TALEN pair TaSBEIIa_T01

SEQ ID NO: 5165 - DNA, 468 bp, Artificial
  TaSBEIIa  allele with mutations introduced by TALEN pair TaSBEIIa_T01
tcagatggatgtgcatttagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5166 - DNA, 469 bp, Artificial; identical to SEQ ID NO: 5084
  TaSBEIIa  allele with mutations introduced by TALEN pair TaSBEIIa_T01

SEQ ID NO: 5167 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5168 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 5169 - DNA, 461 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcatttgaattaaggtccttcgtcatgcaaatttgggaacatcaaagagacaaagactagggaccactattcttacagttcccctcatggtctgagaatatgctggga

SEQ ID NO: 5170 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgttttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 5171 - DNA, 462 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctaccgctactttcgctcatttgaattaaggtcctttcgtcatgcaaatttgggaacatcaaagagacaaagactagggaccactattcttacagttcccctcatggtctgagaatatgctggga

SEQ ID NO: 5172 - DNA, 463 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctaccgctacttcgctcattttgaattaaggtcctttcgtcatgcaaatttgggaacatcaaagagacaaagactagggaccactatttcttacagttcccctcatggtctgagaatatgctggga

SEQ ID NO: 5173 - DNA, 469 bp, Artificial; identical to SEQ ID NO: 5088
  TaSBEIIa  allele with mutations introduced by TALEN pair TaSBEIIa_T01

SEQ ID NO: 5174 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctttttcggagccatcttgactaccggtaatgcctacccgctactttcgctcatttgaattaaggtcctttcgtcatgcaaatttggggaacatcaaagagacaaagactagggaccactatttcttacagtttcccctcatggtctgagaatatgctggga

SEQ ID NO: 5175 - DNA, 470 bp, Artificial; identical to SEQ ID NO: 5112
  TaSBEIIa  allele with mutations introduced by TALEN pair TaSBEIIa_T01

SEQ ID NO: 5176 - DNA, 469 bp, Artificial; identical to SEQ ID NO: 5084
  TaSBEIIa  allele with mutations introduced by TALEN pair TaSBEIIa_T01

SEQ ID NO: 5177 - DNA, 468 bp, Artificial; identical to SEQ ID NO: 5089
  TaSBEIIa  allele with mutations introduced by TALEN pair TaSBEIIa_T01

SEQ ID NO: 5178 - DNA, 470 bp, Artificial; identical to SEQ ID NO: 5112
  TaSBEIIa  allele with mutations introduced by TALEN pair TaSBEIIa_T01

SEQ ID NO: 5179 - DNA, 473 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctcactggtctgagaatatgctggga

SEQ ID NO: 5180 - DNA, 469 bp, Artificial; identical to SEQ ID NO: 5084
  TaSBEIIa  allele with mutations introduced by TALEN pair TaSBEIIa_T01

SEQ ID NO: 5181 - DNA, 468 bp, Artificial
  TaSBEIIa  allele with mutations introduced by TALEN pair TaSBEIIa_T01
tcagatggatgtgcttctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5182 - DNA, 467 bp, Artificial; identical to SEQ ID NO: 5092
  TaSBEIIa  allele with mutations introduced by TALEN pair TaSBEIIa_T01

SEQ ID NO: 5183 - DNA, 467 bp, Artificial; identical to SEQ ID NO: 5092
  TaSBEIIa  allele with mutations introduced by TALEN pair TaSBEIIa_T01

SEQ ID NO: 5184 - DNA, 472 bp, Artificial; identical to SEQ ID NO: 5101
  TaSBEIIa  allele with mutations introduced by TALEN pair TaSBEIIa_T01

SEQ ID NO: 5185 - DNA, 469 bp, Artificial; identical to SEQ ID NO: 5084
  TaSBEIIa  allele with mutations introduced by TALEN pair TaSBEIIa_T01

SEQ ID NO: 5186 - DNA, 472 bp, Artificial; identical to SEQ ID NO: 5101
  TaSBEIIa  allele with mutations introduced by TALEN pair TaSBEIIa_T01

SEQ ID NO: 5187 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttggggaacatcaaagagacaaagactagggaccactatttcttacagttaccctccatggtctgagaataatgctggga

SEQ ID NO: 5188 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttacccctcatggtctgagaatatgctggga

SEQ ID NO: 5189 - DNA, 468 bp, Artificial; identical to SEQ ID NO: 5104
  TaSBEIIa  allele with mutations introduced by TALEN pair TaSBEIIa_T01

SEQ ID NO: 5190 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaatttggggaacatcaaagagacaaagactagggaccactatttcttacagttcccctcatggtctgagaatatgctggga

SEQ ID NO: 5191 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 5192 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagatatgctggga

SEQ ID NO: 5193 - DNA, 468 bp, Artificial; identical to SEQ ID NO: 5089
  TaSBEIIa  allele with mutations introduced by TALEN pair TaSBEIIa_T01

SEQ ID NO: 5194 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5195 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaacaggagatgggcagaaaatatacgagattgacccaacgctgatttcggagccatcttgactaccggtaatgcctacccgctactttcgctcattttgaattaaggtcctttcgtcatgcaaatttgggaacatcaaagagacaaagactagggaccactatttcttacagttcccctcatggtctgagatatgctggga

SEQ ID NO: 5196 - DNA, 469 bp, Artificial; identical to SEQ ID NO: 5124
  TaSBEIIa  allele with mutations introduced by TALEN pair TaSBEIIa_T01

SEQ ID NO: 5197 - DNA, 470 bp, Artificial; identical to SEQ ID NO: 5112
  TaSBEIIa  allele with mutations introduced by TALEN pair TaSBEIIa_T01

SEQ ID NO: 5198 - DNA, 461 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 5199 - DNA, 473 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgattttcggagccatcttgactaccggtaatgcctacccgctaattcgctctattttgaattaaggtcctttcatcatgcaaatttggggaacatcaaagaggacaaagactagggaccactatttcatacagttcccctcatggtctgagaatatgctggga

SEQ ID NO: 5200 - DNA, 469 bp, Artificial; identical to SEQ ID NO: 5124
  TaSBEIIa  allele with mutations introduced by TALEN pair TaSBEIIa_T01

SEQ ID NO: 5201 - DNA, 472 bp, Artificial; identical to SEQ ID NO: 5101
  TaSBEIIa  allele with mutations introduced by TALEN pair TaSBEIIa_T01

SEQ ID NO: 5202 - DNA, 462 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactcggagccatcttgactaccggtaatgcctacccgctgctttcgctcattttgaattaaggtcctttcatcatgcaaatttggggaacatcaaagagacaaagactagggaccaccatttcatacagatcccctgtggtctgagatatgctggga

SEQ ID NO: 5203 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5204 - DNA, 468 bp, Artificial
  TaSBEIIa  allele with mutations introduced by TALEN pair TaSBEIIa_T01
  misc_feature (348): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgntactttcgctcattttgaattaaggtcctttcgtcatgcaaatttggggaacatcaaagagacaaagactagggaccactatttcttacagttcccctcatggtctgagatatgctggga

SEQ ID NO: 5205 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgttttcggagccatcttgactaccggtaatgcctacccgctgctttcgctcattttgaattaaggtcctttcatcatgcaaatttggggaacatcaaagagacaaagactagggaccacatttcatacagatcccctgtggtctgagaatatgctggga

SEQ ID NO: 5206 - DNA, 464 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctaccgctactttcgctcatttgaattaaggtcctttcgtcatgcaaatttggggaacatcaaagagacaaagactagggaccactatttcttacagttcccctcatggtctgagaatatgctggga

SEQ ID NO: 5207 - DNA, 468 bp, Artificial; identical to SEQ ID NO: 5089
  TaSBEIIa  allele with mutations introduced by TALEN pair TaSBEIIa_T01

SEQ ID NO: 5208 - DNA, 470 bp, Artificial; identical to SEQ ID NO: 5112
  TaSBEIIa  allele with mutations introduced by TALEN pair TaSBEIIa_T01

SEQ ID NO: 5209 - DNA, 473 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggacaaagactagggaccactatttcatacagttcccctcatggtctgagaatatgctggga

SEQ ID NO: 5210 - DNA, 468 bp, Artificial; identical to SEQ ID NO: 5089
  TaSBEIIa  allele with mutations introduced by TALEN pair TaSBEIIa_T01

SEQ ID NO: 5211 - DNA, 466 bp, Artificial; identical to SEQ ID NO: 5145
  TaSBEIIa  allele with mutations introduced by TALEN pair TaSBEIIa_T01

SEQ ID NO: 5212 - DNA, 468 bp, Artificial; identical to SEQ ID NO: 5089
  TaSBEIIa  allele with mutations introduced by TALEN pair TaSBEIIa_T01

SEQ ID NO: 5213 - DNA, 467 bp, Artificial; identical to SEQ ID NO: 5092
  TaSBEIIa  allele with mutations introduced by TALEN pair TaSBEIIa_T01

SEQ ID NO: 5214 - DNA, 515 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctttttaaaacgacggccagtgaattcgagctcggtacctcgcgaatgattttcggagccatcttgactaccggtaatgcctacccgctaatttcgctcattttgaattaaggtccttcatcatgcaaatttggggaacatcaaagaggcaaagactagggaccactattcatacagttcccctcatggtctgagaatatgctgggaa

SEQ ID NO: 5215 - DNA, 470 bp, Artificial; identical to SEQ ID NO: 5112
  TaSBEIIa  allele with mutations introduced by TALEN pair TaSBEIIa_T01

SEQ ID NO: 5216 - DNA, 471 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgaattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5217 - DNA, 470 bp, Artificial; identical to SEQ ID NO: 5112
  TaSBEIIa  allele with mutations introduced by TALEN pair TaSBEIIa_T01

SEQ ID NO: 5218 - DNA, 466 bp, Artificial; identical to SEQ ID NO: 5145
  TaSBEIIa  allele with mutations introduced by TALEN pair TaSBEIIa_T01

SEQ ID NO: 5219 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactattttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 5220 - DNA, 468 bp, Artificial; identical to SEQ ID NO: 5089
  TaSBEIIa  allele with mutations introduced by TALEN pair TaSBEIIa_T01

SEQ ID NO: 5221 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggacagaaaatatacgagattgacccaacgctgaattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5222 - DNA, 466 bp, Artificial
  TaSBEIIa  allele with mutations introduced by TALEN pair TaSBEIIa_T01
tcagatggatgtgcattctagcaagaacttcacgaaataatgcactgtttctggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5223 - DNA, 468 bp, Artificial; identical to SEQ ID NO: 5089
  TaSBEIIa  allele with mutations introduced by TALEN pair TaSBEIIa_T01

SEQ ID NO: 5224 - DNA, 467 bp, Artificial; identical to SEQ ID NO: 5092
  TaSBEIIa  allele with mutations introduced by TALEN pair TaSBEIIa_T01

SEQ ID NO: 5225 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacattttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 5226 - DNA, 466 bp, Artificial
  TaSBEIIa  allele with mutations introduced by TALEN pair TaSBEIIa_T01
tcagatggatgtgcattctagcaagaacttcacgaaataatgcactgtgtgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5227 - DNA, 466 bp, Artificial; identical to SEQ ID NO: 5145
  TaSBEIIa  allele with mutations introduced by TALEN pair TaSBEIIa_T01

SEQ ID NO: 5228 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaaccaggagatggacagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 5229 - DNA, 469 bp, Artificial; identical to SEQ ID NO: 5194
  TaSBEIIa  allele with mutations introduced by TALEN pair TaSBEIIa_T01

SEQ ID NO: 5230 - DNA, 470 bp, Artificial
  TaSBEIIa  allele with mutations introduced by TALEN pair TaSBEIIa_T01
  misc_feature (447): n is a or c or t or g
tcagatggatgtgcattactagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcattttgaattaaggtcctttcatcatgcaaatttggggaacatcaaagagacaaagactagggaccaccatttcatacagatcccccncgtggtctgagaatatgctggga

SEQ ID NO: 5231 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 5232 - DNA, 469 bp, Artificial; identical to SEQ ID NO: 5084
  TaSBEIIa  allele with mutations introduced by TALEN pair TaSBEIIa_T01

SEQ ID NO: 5233 - DNA, 466 bp, Artificial; identical to SEQ ID NO: 5145
  TaSBEIIa  allele with mutations introduced by TALEN pair TaSBEIIa_T01

SEQ ID NO: 5234 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5235 - DNA, 468 bp, Artificial; identical to SEQ ID NO: 5234
  TaSBEIIa  allele with mutations introduced by TALEN pair TaSBEIIa_T01

SEQ ID NO: 5236 - DNA, 468 bp, Artificial; identical to SEQ ID NO: 5091
  TaSBEIIa  allele with mutations introduced by TALEN pair TaSBEIIa_T01

SEQ ID NO: 5237 - DNA, 468 bp, Artificial; identical to SEQ ID NO: 5147
  TaSBEIIa  allele with mutations introduced by TALEN pair TaSBEIIa_T01

SEQ ID NO: 5238 - DNA, 469 bp, Artificial; identical to SEQ ID NO: 5084
  TaSBEIIa  allele with mutations introduced by TALEN pair TaSBEIIa_T01

SEQ ID NO: 5239 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5240 - DNA, 472 bp, Artificial; identical to SEQ ID NO: 5101
  TaSBEIIa  allele with mutations introduced by TALEN pair TaSBEIIa_T01

SEQ ID NO: 5241 - DNA, 503 bp, Artificial
  TaSBEIIa  allele with mutations introduced by TALEN pair TaSBEIIa_T01
  misc_feature (466): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgatttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgngtgagtagagtacgcgacgagacacacggaggtagag

SEQ ID NO: 5242 - DNA, 469 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgcttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 5243 - DNA, 442 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgccatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 5244 - DNA, 468 bp, Artificial; identical to SEQ ID NO: 5147
  TaSBEIIa  allele with mutations introduced by TALEN pair TaSBEIIa_T01

SEQ ID NO: 5245 - DNA, 468 bp, Artificial; identical to SEQ ID NO: 5234
  TaSBEIIa  allele with mutations introduced by TALEN pair TaSBEIIa_T01

SEQ ID NO: 5246 - DNA, 464 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttgggaacatcaaagagacaaagactagggaccactatttctacagttcccctcatggtctgagaatatgctggga

SEQ ID NO: 5247 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctatttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 5248 - DNA, 472 bp, Artificial; identical to SEQ ID NO: 5101
  TaSBEIIa  allele with mutations introduced by TALEN pair TaSBEIIa_T01

SEQ ID NO: 5249 - DNA, 472 bp, Artificial; identical to SEQ ID NO: 5101
  TaSBEIIa  allele with mutations introduced by TALEN pair TaSBEIIa_T01

SEQ ID NO: 5250 - DNA, 470 bp, Artificial; identical to SEQ ID NO: 5112
  TaSBEIIa  allele with mutations introduced by TALEN pair TaSBEIIa_T01

SEQ ID NO: 5251 - DNA, 467 bp, Artificial; identical to SEQ ID NO: 5092
  TaSBEIIa  allele with mutations introduced by TALEN pair TaSBEIIa_T01

SEQ ID NO: 5252 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagtccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5253 - DNA, 467 bp, Artificial; identical to SEQ ID NO: 5092
  TaSBEIIa  allele with mutations introduced by TALEN pair TaSBEIIa_T01

SEQ ID NO: 5254 - DNA, 468 bp, Artificial; identical to SEQ ID NO: 5091
  TaSBEIIa  allele with mutations introduced by TALEN pair TaSBEIIa_T01

SEQ ID NO: 5255 - DNA, 471 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagatatgctggga

SEQ ID NO: 5256 - DNA, 470 bp, Artificial
  TaSBEIIa  allele with mutations introduced by TALEN pair TaSBEIIa_T01
  misc_feature (447): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctacccgctactttcgctcattttgaattaaggtcctttcgtcatgcaaatttgggaacatcaaagagacaaagactagggaccactatttcttacagttcccctnactggtctgagaatatgctggga

SEQ ID NO: 5257 - DNA, 466 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacattttcggagtcatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5258 - DNA, 471 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 5259 - DNA, 466 bp, Artificial; identical to SEQ ID NO: 5145
  TaSBEIIa  allele with mutations introduced by TALEN pair TaSBEIIa_T01

SEQ ID NO: 5260 - DNA, 470 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttcgtcccaaaaccaggagatgggcagaaaatatacgagattgacccaacgcttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 5261 - DNA, 466 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccatttcatacagatcccctcgtgtctgagaatatgctggga

SEQ ID NO: 5262 - DNA, 469 bp, Artificial; identical to SEQ ID NO: 5084
  TaSBEIIa  allele with mutations introduced by TALEN pair TaSBEIIa_T01

SEQ ID NO: 5263 - DNA, 461 bp, Artificial; identical to SEQ ID NO: 5198
  TaSBEIIa  allele with mutations introduced by TALEN pair TaSBEIIa_T01

SEQ ID NO: 5264 - DNA, 468 bp, Artificial; identical to SEQ ID NO: 5234
  TaSBEIIa  allele with mutations introduced by TALEN pair TaSBEIIa_T01

SEQ ID NO: 5265 - DNA, 469 bp, Artificial; identical to SEQ ID NO: 5084
  TaSBEIIa  allele with mutations introduced by TALEN pair TaSBEIIa_T01

SEQ ID NO: 5266 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactattttcggagccatcttgactaccggtaatgcctaccgctgctttcgctcattttgaattaaggtcctttcattcatgcaaatttggggaacatcaaagagacaaagactagggaccaccatttcatacagatccctcgtggtctgagaatatgctggga

SEQ ID NO: 5267 - DNA, 467 bp, Artificial; identical to SEQ ID NO: 5095
  TaSBEIIa  allele with mutations introduced by TALEN pair TaSBEIIa_T01

SEQ ID NO: 5268 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgttttcggagccatcttgactaccggtaatgcctacccgctgctttcgctcattttgaattaaggtcctttcatcatgcaaatttggggaacatcaaagagacaaagactagggaaccaccatttcatacagatcccctcgtggtctgagaatatgctggga

SEQ ID NO: 5269 - DNA, 468 bp, Artificial; identical to SEQ ID NO: 5147
  TaSBEIIa  allele with mutations introduced by TALEN pair TaSBEIIa_T01

SEQ ID NO: 5270 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcatttgattaaggtcctttcatcatgcaaatttggggaacatcaaagagacaaagactagggaccaccatttcatacagatcccctcgtggtctgagaatatgctggga

SEQ ID NO: 5271 - DNA, 473 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgtaattaaggtcctttcgttcatgcaaatttggggtaacaatcaaaagaagacaaagaactagggaccactatttcttacagtttcccctcatggtctgagatatgctggga

SEQ ID NO: 5272 - DNA, 472 bp, Artificial; identical to SEQ ID NO: 5101
  TaSBEIIa  allele with mutations introduced by TALEN pair TaSBEIIa_T01

SEQ ID NO: 5273 - DNA, 469 bp, Artificial; identical to SEQ ID NO: 5084
  TaSBEIIa  allele with mutations introduced by TALEN pair TaSBEIIa_T01

SEQ ID NO: 5274 - DNA, 468 bp, Artificial; identical to SEQ ID NO: 5234
  TaSBEIIa  allele with mutations introduced by TALEN pair TaSBEIIa_T01

SEQ ID NO: 5275 - DNA, 468 bp, Artificial; identical to SEQ ID NO: 5234
  TaSBEIIa  allele with mutations introduced by TALEN pair TaSBEIIa_T01

SEQ ID NO: 5276 - DNA, 470 bp, Artificial; identical to SEQ ID NO: 5112
  TaSBEIIa  allele with mutations introduced by TALEN pair TaSBEIIa_T01

SEQ ID NO: 5277 - DNA, 466 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5278 - DNA, 467 bp, Artificial; identical to SEQ ID NO: 5092
  TaSBEIIa  allele with mutations introduced by TALEN pair TaSBEIIa_T01

SEQ ID NO: 5279 - DNA, 467 bp, Artificial; identical to SEQ ID NO: 5148
  TaSBEIIa  allele with mutations introduced by TALEN pair TaSBEIIa_T01

SEQ ID NO: 5280 - DNA, 470 bp, Artificial; identical to SEQ ID NO: 5112
  TaSBEIIa  allele with mutations introduced by TALEN pair TaSBEIIa_T01

SEQ ID NO: 5281 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttctcctcatggtctgagaatatgctggga

SEQ ID NO: 5282 - DNA, 466 bp, Artificial; identical to SEQ ID NO: 5145
  TaSBEIIa  allele with mutations introduced by TALEN pair TaSBEIIa_T01

SEQ ID NO: 5283 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaatttgggaacatcaaagagacaaagactagggaccactattcttacagttcccctcatggtctgagaatatgctggga

SEQ ID NO: 5284 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacagattttcggagccatcttgactaccggtaatgcctacccgctgctttcgctcattttgaattaaggtcctttcatcatgcaaatttggggaacatcaaagagacaaagactagggaccaccatttcatacagatcccctcgtgtctgagaatatgctggga

SEQ ID NO: 5285 - DNA, 443 bp, Artificial; identical to SEQ ID NO: 5106
  TaSBEIIa  allele with mutations introduced by TALEN pair TaSBEIIa_T01

SEQ ID NO: 5286 - DNA, 468 bp, Artificial; identical to SEQ ID NO: 5089
  TaSBEIIa  allele with mutations introduced by TALEN pair TaSBEIIa_T01

SEQ ID NO: 5287 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtaggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 5288 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5289 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 5290 - DNA, 471 bp, Artificial; identical to SEQ ID NO: 5216
  TaSBEIIa  allele with mutations introduced by TALEN pair TaSBEIIa_T01

SEQ ID NO: 5291 - DNA, 469 bp, Artificial; identical to SEQ ID NO: 5084
  TaSBEIIa  allele with mutations introduced by TALEN pair TaSBEIIa_T01

SEQ ID NO: 5292 - DNA, 469 bp, Artificial; identical to SEQ ID NO: 5084
  TaSBEIIa  allele with mutations introduced by TALEN pair TaSBEIIa_T01

SEQ ID NO: 5293 - DNA, 468 bp, Artificial; identical to SEQ ID NO: 5234
  TaSBEIIa  allele with mutations introduced by TALEN pair TaSBEIIa_T01

SEQ ID NO: 5294 - DNA, 470 bp, Artificial; identical to SEQ ID NO: 5112
  TaSBEIIa  allele with mutations introduced by TALEN pair TaSBEIIa_T01

SEQ ID NO: 5295 - DNA, 500 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaagagacaaagactagggaccactattcttacagttccctcactggtctgagaatatgctgggactgacgctcgacgacggcacacggagggagtag

SEQ ID NO: 5296 - DNA, 469 bp, Artificial; identical to SEQ ID NO: 5084
  TaSBEIIa  allele with mutations introduced by TALEN pair TaSBEIIa_T01

SEQ ID NO: 5297 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgatttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 5298 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 5299 - DNA, 464 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacttttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatcgctggga

SEQ ID NO: 5300 - DNA, 468 bp, Artificial; identical to SEQ ID NO: 5091
  TaSBEIIa  allele with mutations introduced by TALEN pair TaSBEIIa_T01

SEQ ID NO: 5301 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagttcccctcatggtctgagaatatgctggga

SEQ ID NO: 5302 - DNA, 467 bp, Artificial; identical to SEQ ID NO: 5092
  TaSBEIIa  allele with mutations introduced by TALEN pair TaSBEIIa_T01

SEQ ID NO: 5303 - DNA, 472 bp, Artificial; identical to SEQ ID NO: 5101
  TaSBEIIa  allele with mutations introduced by TALEN pair TaSBEIIa_T01

SEQ ID NO: 5304 - DNA, 470 bp, Artificial; identical to SEQ ID NO: 5112
  TaSBEIIa  allele with mutations introduced by TALEN pair TaSBEIIa_T01

SEQ ID NO: 5305 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 5306 - DNA, 469 bp, Artificial; identical to SEQ ID NO: 5084
  TaSBEIIa  allele with mutations introduced by TALEN pair TaSBEIIa_T01

SEQ ID NO: 5307 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctttttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 5308 - DNA, 467 bp, Artificial; identical to SEQ ID NO: 5092
  TaSBEIIa  allele with mutations introduced by TALEN pair TaSBEIIa_T01

SEQ ID NO: 5309 - DNA, 467 bp, Artificial; identical to SEQ ID NO: 5092
  TaSBEIIa  allele with mutations introduced by TALEN pair TaSBEIIa_T01

SEQ ID NO: 5310 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 5311 - DNA, 464 bp, Artificial; identical to SEQ ID NO: 5105
  TaSBEIIa  allele with mutations introduced by TALEN pair TaSBEIIa_T01

SEQ ID NO: 5312 - DNA, 468 bp, Artificial; identical to SEQ ID NO: 5089
  TaSBEIIa  allele with mutations introduced by TALEN pair TaSBEIIa_T01

SEQ ID NO: 5313 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagaattgacccaacgctgttttcggagccaatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5314 - DNA, 469 bp, Artificial; identical to SEQ ID NO: 5084
  TaSBEIIa  allele with mutations introduced by TALEN pair TaSBEIIa_T01

SEQ ID NO: 5315 - DNA, 468 bp, Artificial; identical to SEQ ID NO: 5089
  TaSBEIIa  allele with mutations introduced by TALEN pair TaSBEIIa_T01

SEQ ID NO: 5316 - DNA, 470 bp, Artificial; identical to SEQ ID NO: 5112
  TaSBEIIa  allele with mutations introduced by TALEN pair TaSBEIIa_T01

SEQ ID NO: 5317 - DNA, 463 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcatttgaattaaggtcctttcgtcatgcaaatttggggaacatcaaagagacaaagactagggaccactattcttacagttccctcatggtctgagaatatgctggga

SEQ ID NO: 5318 - DNA, 467 bp, Artificial; identical to SEQ ID NO: 5092
  TaSBEIIa  allele with mutations introduced by TALEN pair TaSBEIIa_T01

SEQ ID NO: 5319 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggacactatttcttacagttcccctcatggtctgagaatatgctggga

SEQ ID NO: 5320 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaaatatacgagattgacccaacgctgattttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 5321 - DNA, 465 bp, Artificial; identical to SEQ ID NO: 5289
  TaSBEIIa  allele with mutations introduced by TALEN pair TaSBEIIa_T01

SEQ ID NO: 5322 - DNA, 466 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaagattttcggagccatcttgactaccggtaatgcctaccgctgctttcgctcattttgaattaaggtcctttcatcatgcaaatttggggaacatcaaagagacaaagactagggaccaccatttcatacagatcccctcgtggtcctgagaatatgctggga

SEQ ID NO: 5323 - DNA, 468 bp, Artificial; identical to SEQ ID NO: 5091
  TaSBEIIa  allele with mutations introduced by TALEN pair TaSBEIIa_T01

SEQ ID NO: 5324 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttgggaacatacaaagagacaaagactagggaccactattcttacagttcccctcatggtctgagaatatgctggga

SEQ ID NO: 5325 - DNA, 470 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgcattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 5326 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctttttcggagccatcttgactaccggtaatgcctacccgctactttcgctcatttgaattaaggtcctttcgtcatgcaaatttggggaacatcaaagagacaaagactagggaccactatttcttacagttcccctcatggtctgagaatatgctggga

SEQ ID NO: 5327 - DNA, 467 bp, Artificial; identical to SEQ ID NO: 5092
  TaSBEIIa  allele with mutations introduced by TALEN pair TaSBEIIa_T01

SEQ ID NO: 5328 - DNA, 468 bp, Artificial; identical to SEQ ID NO: 5089
  TaSBEIIa  allele with mutations introduced by TALEN pair TaSBEIIa_T01

SEQ ID NO: 5329 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtacccaaaaccaggagatgggcagaaaatatacgagattgacccaacactaattttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5330 - DNA, 466 bp, Artificial; identical to SEQ ID NO: 5145
  TaSBEIIa  allele with mutations introduced by TALEN pair TaSBEIIa_T01

SEQ ID NO: 5331 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcattgcaaatttggggaacatcaaagagacaaagactagggaccactatttcttacagttcccctcatggtctgagaatatgctggga

SEQ ID NO: 5332 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctaccgctactttcgctcattttgaattaaggtcctttcgtcatgcaaatttgggaacatcaaagagacaaagactagggaccactatttcttacagttcccctcatggtctgagaatatgctggga

SEQ ID NO: 5333 - DNA, 464 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgccatcttgactaccggtaatgcctacccgctaatttcgctcattttgaatttaaggtcctttcattcatgcaaatttggggaacatcaaagaggcaaagactagggaccactatttcatacagttcccctcatggtctgagaatatgctggga

SEQ ID NO: 5334 - DNA, 469 bp, Artificial; identical to SEQ ID NO: 5084
  TaSBEIIa  allele with mutations introduced by TALEN pair TaSBEIIa_T01

SEQ ID NO: 5335 - DNA, 472 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcatttttgaatttaaggtcctttcatcatgcaaatttggggaacatcaaagagacaaagactagggaccaccatttcatacagatcccctcgtggtctgagaatatgctggga

SEQ ID NO: 5336 - DNA, 468 bp, Artificial; identical to SEQ ID NO: 5170
  TaSBEIIa  allele with mutations introduced by TALEN pair TaSBEIIa_T01

SEQ ID NO: 5337 - DNA, 468 bp, Artificial; identical to SEQ ID NO: 5089
  TaSBEIIa  allele with mutations introduced by TALEN pair TaSBEIIa_T01

SEQ ID NO: 5338 - DNA, 472 bp, Artificial; identical to SEQ ID NO: 5101
  TaSBEIIa  allele with mutations introduced by TALEN pair TaSBEIIa_T01

SEQ ID NO: 5339 - DNA, 540 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtcttagaataatagtcgtggtacggtagtaggaacgttagtccgaaccggaacggaccaaccaacggggtaagggtaaggtaagggaga

SEQ ID NO: 5340 - DNA, 470 bp, Artificial; identical to SEQ ID NO: 5112
  TaSBEIIa  allele with mutations introduced by TALEN pair TaSBEIIa_T01

SEQ ID NO: 5341 - DNA, 469 bp, Artificial; identical to SEQ ID NO: 5084
  TaSBEIIa  allele with mutations introduced by TALEN pair TaSBEIIa_T01

SEQ ID NO: 5342 - DNA, 468 bp, Artificial; identical to SEQ ID NO: 5147
  TaSBEIIa  allele with mutations introduced by TALEN pair TaSBEIIa_T01

SEQ ID NO: 5343 - DNA, 469 bp, Artificial; identical to SEQ ID NO: 5134
  TaSBEIIa  allele with mutations introduced by TALEN pair TaSBEIIa_T01

SEQ ID NO: 5344 - DNA, 468 bp, Artificial; identical to SEQ ID NO: 5089
  TaSBEIIa  allele with mutations introduced by TALEN pair TaSBEIIa_T01

SEQ ID NO: 5345 - DNA, 470 bp, Artificial; identical to SEQ ID NO: 5112
  TaSBEIIa  allele with mutations introduced by TALEN pair TaSBEIIa_T01

SEQ ID NO: 5346 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttggggaacatcaaagagacaaagactagggaccactaatttcttacagttcccctcatggtctgagaatatgctggga

SEQ ID NO: 5347 - DNA, 468 bp, Artificial; identical to SEQ ID NO: 5083
  TaSBEIIa  allele with mutations introduced by TALEN pair TaSBEIIa_T01

SEQ ID NO: 5348 - DNA, 469 bp, Artificial; identical to SEQ ID NO: 5124
  TaSBEIIa  allele with mutations introduced by TALEN pair TaSBEIIa_T01

SEQ ID NO: 5349 - DNA, 468 bp, Artificial; identical to SEQ ID NO: 5091
  TaSBEIIa  allele with mutations introduced by TALEN pair TaSBEIIa_T01

SEQ ID NO: 5350 - DNA, 469 bp, Artificial; identical to SEQ ID NO: 5084
  TaSBEIIa  allele with mutations introduced by TALEN pair TaSBEIIa_T01

SEQ ID NO: 5351 - DNA, 469 bp, Artificial; identical to SEQ ID NO: 5084
  TaSBEIIa  allele with mutations introduced by TALEN pair TaSBEIIa_T01

SEQ ID NO: 5352 - DNA, 468 bp, Artificial; identical to SEQ ID NO: 5089
  TaSBEIIa  allele with mutations introduced by TALEN pair TaSBEIIa_T01

SEQ ID NO: 5353 - DNA, 468 bp, Artificial; identical to SEQ ID NO: 5234
  TaSBEIIa  allele with mutations introduced by TALEN pair TaSBEIIa_T01

SEQ ID NO: 5354 - DNA, 468 bp, Artificial; identical to SEQ ID NO: 5091
  TaSBEIIa  allele with mutations introduced by TALEN pair TaSBEIIa_T01

SEQ ID NO: 5355 - DNA, 467 bp, Artificial; identical to SEQ ID NO: 5191
  TaSBEIIa  allele with mutations introduced by TALEN pair TaSBEIIa_T01

SEQ ID NO: 5356 - DNA, 470 bp, Artificial; identical to SEQ ID NO: 5112
  TaSBEIIa  allele with mutations introduced by TALEN pair TaSBEIIa_T01

SEQ ID NO: 5357 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtccttttcgtcatgcaaatttggggaacatcaaagagacaaagactagggaccactatttcttacagttcccctcatggtctgagaatatgctggga

SEQ ID NO: 5358 - DNA, 472 bp, Artificial; identical to SEQ ID NO: 5101
  TaSBEIIa  allele with mutations introduced by TALEN pair TaSBEIIa_T01

SEQ ID NO: 5359 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactattttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5360 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgttttcggagccatcttgactaccggtaatgcctaccgctgctttcgctcattttgaattaaggtcctttcatcatgcaaatttggggaacatcaaagagacaaagactagggaccaccatttcatacagatcccctgtggtctgagaatatgctggga

SEQ ID NO: 5361 - DNA, 464 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctaccgctactttcgctcattttgaattaaggtccttgtcatgcaaatttgggaacatcaaagagacaaagactagggaccactatttcttacagttccctcatggtctgagaatatgctggga

SEQ ID NO: 5362 - DNA, 470 bp, Artificial; identical to SEQ ID NO: 5112
  TaSBEIIa  allele with mutations introduced by TALEN pair TaSBEIIa_T01

SEQ ID NO: 5363 - DNA, 469 bp, Artificial; identical to SEQ ID NO: 5084
  TaSBEIIa  allele with mutations introduced by TALEN pair TaSBEIIa_T01

SEQ ID NO: 5364 - DNA, 467 bp, Artificial; identical to SEQ ID NO: 5092
  TaSBEIIa  allele with mutations introduced by TALEN pair TaSBEIIa_T01

SEQ ID NO: 5365 - DNA, 468 bp, Artificial; identical to SEQ ID NO: 5089
  TaSBEIIa  allele with mutations introduced by TALEN pair TaSBEIIa_T01

SEQ ID NO: 5366 - DNA, 469 bp, Artificial; identical to SEQ ID NO: 5242
  TaSBEIIa  allele with mutations introduced by TALEN pair TaSBEIIa_T01

SEQ ID NO: 5367 - DNA, 468 bp, Artificial; identical to SEQ ID NO: 5231
  TaSBEIIa  allele with mutations introduced by TALEN pair TaSBEIIa_T01

SEQ ID NO: 5368 - DNA, 468 bp, Artificial; identical to SEQ ID NO: 5234
  TaSBEIIa  allele with mutations introduced by TALEN pair TaSBEIIa_T01

SEQ ID NO: 5369 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgaattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctgga

SEQ ID NO: 5370 - DNA, 468 bp, Artificial; identical to SEQ ID NO: 5231
  TaSBEIIa  allele with mutations introduced by TALEN pair TaSBEIIa_T01

SEQ ID NO: 5371 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctaccgctactttcgctcattttgaattaaggtcctttcgtcatgcaaatttgggaacatcaaagagacaaagactagggaccactatttcttacagttcccctcatggtctgagaatatgctggga

SEQ ID NO: 5372 - DNA, 468 bp, Artificial; identical to SEQ ID NO: 5234
  TaSBEIIa  allele with mutations introduced by TALEN pair TaSBEIIa_T01

SEQ ID NO: 5373 - DNA, 468 bp, Artificial; identical to SEQ ID NO: 5091
  TaSBEIIa  allele with mutations introduced by TALEN pair TaSBEIIa_T01

SEQ ID NO: 5374 - DNA, 443 bp, Artificial; identical to SEQ ID NO: 5106
  TaSBEIIa  allele with mutations introduced by TALEN pair TaSBEIIa_T01

SEQ ID NO: 5375 - DNA, 470 bp, Artificial; identical to SEQ ID NO: 5203
  TaSBEIIa  allele with mutations introduced by TALEN pair TaSBEIIa_T01

SEQ ID NO: 5376 - DNA, 469 bp, Artificial; identical to SEQ ID NO: 5099
  TaSBEIIa  allele with mutations introduced by TALEN pair TaSBEIIa_T01

SEQ ID NO: 5377 - DNA, 466 bp, Artificial
  TaSBEIIa  allele with mutations introduced by TALEN pair TaSBEIIa_T01
tcagatggatgtgcattctatcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcattttgaattaaggtcctttcatcatgcaaatttggggaacatcaaagagacaaagactagggaccaccatttcatacagatcccctgtgtctgagaatatgctggga

SEQ ID NO: 5378 - DNA, 464 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 5379 - DNA, 469 bp, Artificial; identical to SEQ ID NO: 5084
  TaSBEIIa  allele with mutations introduced by TALEN pair TaSBEIIa_T01

SEQ ID NO: 5380 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttggggaacatcaaagagacaaagactagggaccactatttcttacagttcccctcactggtctgagaatatgctggga

SEQ ID NO: 5381 - DNA, 468 bp, Artificial; identical to SEQ ID NO: 5234
  TaSBEIIa  allele with mutations introduced by TALEN pair TaSBEIIa_T01

SEQ ID NO: 5382 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 5383 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgaattttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 5384 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttctacagttcccctcatggctgagaatatgctggga

SEQ ID NO: 5385 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtccttcatcatgcaaatttggggaacatcaaagagacaaagactagggaccaccatttcatacagatcccctcgtggtctgagaatatgctggga

SEQ ID NO: 5386 - DNA, 472 bp, Artificial; identical to SEQ ID NO: 5101
  TaSBEIIa  allele with mutations introduced by TALEN pair TaSBEIIa_T01

SEQ ID NO: 5387 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaaacatgacaggggggactgcagagaaacttcaatcttcagaaccgactcagggcattgtggaaacaatcactgatggtgtaaccaaaggagttaaggaactagtcggtgggggagaaaccgcgagttgtacccaaaaccaggagatgggcagaaaatatacgagattgacccaagattttcggagtccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5388 - DNA, 469 bp, Artificial
  TaSBEIIa  allele with mutations introduced by TALEN pair TaSBEIIa_T01
  misc_feature (107): n is a or c or t or g
tcagatggatgtgcattctagcaagaacttcacgaaataatgcactgtttgtggtttcgttagtctgctctacaattgctattttcgtgctgtagatacctgaaganatcgaggagcaaacggctgaagtaaacatgacaggggggactgcagaaaaacttgaatcttcagaaccgactcaaggcattgtggaaacaatcactgatggtgtaaccaagggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5389 - DNA, 468 bp, Artificial; identical to SEQ ID NO: 5234
  TaSBEIIa  allele with mutations introduced by TALEN pair TaSBEIIa_T01

SEQ ID NO: 5390 - DNA, 472 bp, Artificial; identical to SEQ ID NO: 5101
  TaSBEIIa  allele with mutations introduced by TALEN pair TaSBEIIa_T01

SEQ ID NO: 5391 - DNA, 469 bp, Artificial; identical to SEQ ID NO: 5084
  TaSBEIIa  allele with mutations introduced by TALEN pair TaSBEIIa_T01

SEQ ID NO: 5392 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgattaaggtcctttcatcatgcaaatttggggaacatcaaagagacaaagactagggaccaccatttcatacagatcccctcgtggtctgagaatatgctggga

SEQ ID NO: 5393 - DNA, 470 bp, Artificial; identical to SEQ ID NO: 5167
  TaSBEIIa  allele with mutations introduced by TALEN pair TaSBEIIa_T01

SEQ ID NO: 5394 - DNA, 442 bp, Artificial
  TaSBEIIa  allele with mutations introduced by TALEN pair TaSBEIIa_T01
cagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5395 - DNA, 468 bp, Artificial; identical to SEQ ID NO: 5089
  TaSBEIIa  allele with mutations introduced by TALEN pair TaSBEIIa_T01

SEQ ID NO: 5396 - DNA, 466 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 5397 - DNA, 468 bp, Artificial
  TaSBEIIa  allele with mutations introduced by TALEN pair TaSBEIIa_T01
  misc_feature (449): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccacatttcatacagatcccctcgnggtctgagaatatgcggga

SEQ ID NO: 5398 - DNA, 469 bp, Artificial; identical to SEQ ID NO: 5242
  TaSBEIIa  allele with mutations introduced by TALEN pair TaSBEIIa_T01

SEQ ID NO: 5399 - DNA, 463 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgccatcttgactaccggtaatgcctacccgctaatttcgctcattttgaattaaggtcctttcatcatgcaaatttggggaacatcaaagaggcaaagactagggaccactatttcatacagttcccctcactggtctgagaatatgctggga

SEQ ID NO: 5400 - DNA, 468 bp, Artificial; identical to SEQ ID NO: 5091
  TaSBEIIa  allele with mutations introduced by TALEN pair TaSBEIIa_T01

SEQ ID NO: 5401 - DNA, 467 bp, Artificial; identical to SEQ ID NO: 5092
  TaSBEIIa  allele with mutations introduced by TALEN pair TaSBEIIa_T01

SEQ ID NO: 5402 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaaagagacaaagactagggaccactatttcttacagttcccctcatggtctgagaatatgctggga

SEQ ID NO: 5403 - DNA, 465 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaaattttcggagccatcttgactaccggtaatgcctacccgctaatttcgctcattttgaattaaggtcctttcatcatgcaaatttgggaacatcaaagagcaaagactagggaccactatttcatacagttcccctcatggtctgagaatatgctggga

SEQ ID NO: 5404 - DNA, 468 bp, Artificial; identical to SEQ ID NO: 5089
  TaSBEIIa  allele with mutations introduced by TALEN pair TaSBEIIa_T01

SEQ ID NO: 5405 - DNA, 466 bp, Artificial; identical to SEQ ID NO: 5277
  TaSBEIIa  allele with mutations introduced by TALEN pair TaSBEIIa_T01

SEQ ID NO: 5406 - DNA, 471 bp, Artificial; identical to SEQ ID NO: 5216
  TaSBEIIa  allele with mutations introduced by TALEN pair TaSBEIIa_T01

SEQ ID NO: 5407 - DNA, 468 bp, Artificial
  TaSBEIIa  allele with mutations introduced by TALEN pair TaSBEIIa_T01
  misc_feature (447): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctnatggtctgagaatatgctgga

SEQ ID NO: 5408 - DNA, 469 bp, Artificial; identical to SEQ ID NO: 5084
  TaSBEIIa  allele with mutations introduced by TALEN pair TaSBEIIa_T01

SEQ ID NO: 5409 - DNA, 470 bp, Artificial; identical to SEQ ID NO: 5112
  TaSBEIIa  allele with mutations introduced by TALEN pair TaSBEIIa_T01

SEQ ID NO: 5410 - DNA, 473 bp, Artificial; identical to SEQ ID NO: 5209
  TaSBEIIa  allele with mutations introduced by TALEN pair TaSBEIIa_T01

SEQ ID NO: 5411 - DNA, 470 bp, Artificial; identical to SEQ ID NO: 5112
  TaSBEIIa  allele with mutations introduced by TALEN pair TaSBEIIa_T01

SEQ ID NO: 5412 - DNA, 466 bp, Artificial
  TaSBEIIa  allele with mutations introduced by TALEN pair TaSBEIIa_T01
  misc_feature (444): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccatttcatacagatccccncgtggtctgagaatatgctgga

SEQ ID NO: 5413 - DNA, 511 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgtttcggagccatcttgactaccggtaatgcctacccgctgctttcgctcattttgaattaaggtcctttcatcatgcaaatttggggaacatcaaagagacaaagactagggaccaccatttcatacagactccctcgtgtctgagaatatgtcgtgggactgacgtactcgaccgaacggcaacacggaaggggtagtagg

SEQ ID NO: 5414 - DNA, 469 bp, Artificial; identical to SEQ ID NO: 5124
  TaSBEIIa  allele with mutations introduced by TALEN pair TaSBEIIa_T01

SEQ ID NO: 5415 - DNA, 470 bp, Artificial; identical to SEQ ID NO: 5112
  TaSBEIIa  allele with mutations introduced by TALEN pair TaSBEIIa_T01

SEQ ID NO: 5416 - DNA, 468 bp, Artificial; identical to SEQ ID NO: 5231
  TaSBEIIa  allele with mutations introduced by TALEN pair TaSBEIIa_T01

SEQ ID NO: 5417 - DNA, 470 bp, Artificial
  TaSBEIIa  allele with mutations introduced by TALEN pair TaSBEIIa_T01
tcagatggatgtgtcattctaagcaagaacttcacaacataatgcaccgtttggggtttcgtcagtctgctctacaattgctatttttcgtactgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactatttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5418 - DNA, 467 bp, Artificial; identical to SEQ ID NO: 5148
  TaSBEIIa  allele with mutations introduced by TALEN pair TaSBEIIa_T01

SEQ ID NO: 5419 - DNA, 467 bp, Artificial; identical to SEQ ID NO: 5092
  TaSBEIIa  allele with mutations introduced by TALEN pair TaSBEIIa_T01

SEQ ID NO: 5420 - DNA, 470 bp, Artificial; identical to SEQ ID NO: 5112
  TaSBEIIa  allele with mutations introduced by TALEN pair TaSBEIIa_T01

SEQ ID NO: 5421 - DNA, 465 bp, Artificial
  TaSBEIIa  allele with mutations introduced by TALEN pair TaSBEIIa_T01
tcagatggatgtgcttctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 5422 - DNA, 467 bp, Artificial; identical to SEQ ID NO: 5092
  TaSBEIIa  allele with mutations introduced by TALEN pair TaSBEIIa_T01

SEQ ID NO: 5423 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactattttcggagccatcttgactaccggtaatgcctacccgctgctttcgctcattttgaattaaggtcctttcatcatgcaaatttggggaacatcaaagagacaaagactagggaccaccatttcatacagatccctcgtggtctgagaatatgctggga

SEQ ID NO: 5424 - DNA, 471 bp, Artificial; identical to SEQ ID NO: 5258
  TaSBEIIa  allele with mutations introduced by TALEN pair TaSBEIIa_T01

SEQ ID NO: 5425 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgattaaggtcctttcatcatgcaaatttggggaacatcaaagagacaagactagggaccaccatttcatacagatcccctcgtggtctgagaatatgctgga

SEQ ID NO: 5426 - DNA, 468 bp, Artificial
  TaSBEIIa  allele with mutations introduced by TALEN pair TaSBEIIa_T01
tcagatggatgtgcattactagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5427 - DNA, 468 bp, Artificial; identical to SEQ ID NO: 5091
  TaSBEIIa  allele with mutations introduced by TALEN pair TaSBEIIa_T01

SEQ ID NO: 5428 - DNA, 467 bp, Artificial; identical to SEQ ID NO: 5305
  TaSBEIIa  allele with mutations introduced by TALEN pair TaSBEIIa_T01

SEQ ID NO: 5429 - DNA, 469 bp, Artificial; identical to SEQ ID NO: 5357
  TaSBEIIa  allele with mutations introduced by TALEN pair TaSBEIIa_T01

SEQ ID NO: 5430 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacgttccctccatggtctgagaataatgctggga

SEQ ID NO: 5431 - DNA, 468 bp, Artificial; identical to SEQ ID NO: 5310
  TaSBEIIa  allele with mutations introduced by TALEN pair TaSBEIIa_T01

SEQ ID NO: 5432 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgttttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctgga

SEQ ID NO: 5433 - DNA, 474 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgaattttcggagccatcttgactaccggtaatgcctacccgctgctttcgctcatttttgaatttaaggtcctttcatcatgcaaatttggggaacatcaaagagacaaagactagggaccaccatttcatacagatcccctcgtggtctgagaatatgctggga

SEQ ID NO: 5434 - DNA, 467 bp, Artificial; identical to SEQ ID NO: 5148
  TaSBEIIa  allele with mutations introduced by TALEN pair TaSBEIIa_T01

SEQ ID NO: 5435 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcattcatgcaaatttggggaacatcaaagagacaaagactagggaccaccatttcatacagatcccctcgtggtctgagaatatgctggga

SEQ ID NO: 5436 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 5437 - DNA, 467 bp, Artificial; identical to SEQ ID NO: 5092
  TaSBEIIa  allele with mutations introduced by TALEN pair TaSBEIIa_T01

SEQ ID NO: 5438 - DNA, 466 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtccttcatcatgcaaatttggggaacatcaaagagacaaagactagggaccaccatttcatacagatcccctcgtggtctgagaatatgctggga

SEQ ID NO: 5439 - DNA, 470 bp, Artificial; identical to SEQ ID NO: 5203
  TaSBEIIa  allele with mutations introduced by TALEN pair TaSBEIIa_T01

SEQ ID NO: 5440 - DNA, 504 bp, Artificial
  TaSBEIIa  allele with mutations introduced by TALEN pair TaSBEIIa_T01
  misc_feature (466): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgtgnggtctagacgacgtcgacgacggacacacggaggagag

SEQ ID NO: 5441 - DNA, 464 bp, Artificial; identical to SEQ ID NO: 5105
  TaSBEIIa  allele with mutations introduced by TALEN pair TaSBEIIa_T01

SEQ ID NO: 5442 - DNA, 468 bp, Artificial; identical to SEQ ID NO: 5234
  TaSBEIIa  allele with mutations introduced by TALEN pair TaSBEIIa_T01

SEQ ID NO: 5443 - DNA, 469 bp, Artificial; identical to SEQ ID NO: 5194
  TaSBEIIa  allele with mutations introduced by TALEN pair TaSBEIIa_T01

SEQ ID NO: 5444 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctacttcgctcattttgaattaaggtccttttcgtcatgcaaatttgggaacatcaaagagacaaagactagggaccactattcttacagttcccctcatggtctgagaactatgctggga

SEQ ID NO: 5445 - DNA, 468 bp, Artificial; identical to SEQ ID NO: 5091
  TaSBEIIa  allele with mutations introduced by TALEN pair TaSBEIIa_T01

SEQ ID NO: 5446 - DNA, 470 bp, Artificial; identical to SEQ ID NO: 5112
  TaSBEIIa  allele with mutations introduced by TALEN pair TaSBEIIa_T01

SEQ ID NO: 5447 - DNA, 469 bp, Artificial
  TaSBEIIa  allele with mutations introduced by TALEN pair TaSBEIIa_T01
tcagatggatgtgcattctagcaagaacttcacgaaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcatttgaattaaggtcctttcgtcatgcaaatttggggaacatcaaagagacaaagactagggaccactatttcttacagttcccctcatggtctgagaatatgctggga

SEQ ID NO: 5448 - DNA, 471 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaaacaatcactgatggtgtaaccaaaggagttaaggaactagtcgcgggggagaaaccgcgagttgtcccaaaaccaggagatgggcagaaaatatacgagattgacccaacgcttttcggagccatcttgactaccggtaatgcctacccgctaatttcgctcattttgaattaaggtcctttcatcatgcaaatttggggaacatcaaagaggacaaagactagggaccactatttcatacagttcccctcatggtctgagaatatgctggga

SEQ ID NO: 5449 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatactgctggga

SEQ ID NO: 5450 - DNA, 464 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5451 - DNA, 468 bp, Artificial; identical to SEQ ID NO: 5147
  TaSBEIIa  allele with mutations introduced by TALEN pair TaSBEIIa_T01

SEQ ID NO: 5452 - DNA, 468 bp, Artificial; identical to SEQ ID NO: 5089
  TaSBEIIa  allele with mutations introduced by TALEN pair TaSBEIIa_T01

SEQ ID NO: 5453 - DNA, 468 bp, Artificial; identical to SEQ ID NO: 5234
  TaSBEIIa  allele with mutations introduced by TALEN pair TaSBEIIa_T01

SEQ ID NO: 5454 - DNA, 466 bp, Artificial; identical to SEQ ID NO: 5396
  TaSBEIIa  allele with mutations introduced by TALEN pair TaSBEIIa_T01

SEQ ID NO: 5455 - DNA, 470 bp, Artificial; identical to SEQ ID NO: 5203
  TaSBEIIa  allele with mutations introduced by TALEN pair TaSBEIIa_T01

SEQ ID NO: 5456 - DNA, 468 bp, Artificial; identical to SEQ ID NO: 5089
  TaSBEIIa  allele with mutations introduced by TALEN pair TaSBEIIa_T01

SEQ ID NO: 5457 - DNA, 472 bp, Artificial; identical to SEQ ID NO: 5101
  TaSBEIIa  allele with mutations introduced by TALEN pair TaSBEIIa_T01

SEQ ID NO: 5458 - DNA, 468 bp, Artificial; identical to SEQ ID NO: 5089
  TaSBEIIa  allele with mutations introduced by TALEN pair TaSBEIIa_T01

SEQ ID NO: 5459 - DNA, 467 bp, Artificial; identical to SEQ ID NO: 5092
  TaSBEIIa  allele with mutations introduced by TALEN pair TaSBEIIa_T01

SEQ ID NO: 5460 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 5461 - DNA, 467 bp, Artificial; identical to SEQ ID NO: 5092
  TaSBEIIa  allele with mutations introduced by TALEN pair TaSBEIIa_T01

SEQ ID NO: 5462 - DNA, 470 bp, Artificial; identical to SEQ ID NO: 5112
  TaSBEIIa  allele with mutations introduced by TALEN pair TaSBEIIa_T01

SEQ ID NO: 5463 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccatttcatacagactcccctcgtggtctgagaatatgctggga

SEQ ID NO: 5464 - DNA, 464 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtccaaaaccaggagatgggcagaaaatatacgagattgacccaacgcttttcggagccatcttgactaccggtaatgcctacccgctactttcgctcattttgaattaaggtccttcgtcatgcaaatttggggaacatcaaagagacaaagactagggaccactatttcttacagttcccctcatggtctgagaatatgctggga

SEQ ID NO: 5465 - DNA, 470 bp, Artificial; identical to SEQ ID NO: 5112
  TaSBEIIa  allele with mutations introduced by TALEN pair TaSBEIIa_T01

SEQ ID NO: 5466 - DNA, 467 bp, Artificial; identical to SEQ ID NO: 5092
  TaSBEIIa  allele with mutations introduced by TALEN pair TaSBEIIa_T01

SEQ ID NO: 5467 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 5468 - DNA, 463 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacttttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 5469 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctaccgctacttcgctcatttgaattaaggtcctttcgtcatgcaaatttggggaacatacaaagagacaaagactagggaccactattcttacagttccctcatggtctgagaatatgctggga

SEQ ID NO: 5470 - DNA, 470 bp, Artificial; identical to SEQ ID NO: 5112
  TaSBEIIa  allele with mutations introduced by TALEN pair TaSBEIIa_T01

SEQ ID NO: 5471 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtccttcgtcatgcaaatttggggaacatcaaagagacaaagactagggaccactatttcttacagttcccctcatggtctgagaatatgctggga

SEQ ID NO: 5472 - DNA, 469 bp, Artificial; identical to SEQ ID NO: 5084
  TaSBEIIa  allele with mutations introduced by TALEN pair TaSBEIIa_T01

SEQ ID NO: 5473 - DNA, 471 bp, Artificial; identical to SEQ ID NO: 5216
  TaSBEIIa  allele with mutations introduced by TALEN pair TaSBEIIa_T01

SEQ ID NO: 5474 - DNA, 470 bp, Artificial; identical to SEQ ID NO: 5112
  TaSBEIIa  allele with mutations introduced by TALEN pair TaSBEIIa_T01

SEQ ID NO: 5475 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 5476 - DNA, 520 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgtttttgctcacccagaaacgctggtgaaagtaaaagatgctgaagatcagttgggtgcacgagtgggttattttcggagccatcttgactaccggtaatgcctacccgctaatttcgctcattttgaattaaggtcctttcatcatgcaaatttggggaacatcaaagaggcaaagactagggaccactatttcatacagttcccctct

SEQ ID NO: 5477 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttgggaacatcaaagagacaaagactagggaccactatttcttacagttccctcatggtctgagaatatgctggga

SEQ ID NO: 5478 - DNA, 468 bp, Artificial
  TaSBEIIa  allele with mutations introduced by TALEN pair TaSBEIIa_T01
  misc_feature (460): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacagattttcggagccatcttgactaccggtaatgcctacccgctgctttcgctcattttgaattaaggtcctttcatcatgcaaatttggggaacatcaaagagacaaagactagggaccaccatttcatacagatcccctctggtctgagaanatgctgga

SEQ ID NO: 5479 - DNA, 470 bp, Artificial
  TaSBEIIa  allele with mutations introduced by TALEN pair TaSBEIIa_T01
  misc_feature (381): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttnatcatgcaaatttggggaacatcaaagagacaaagactagggaccaccatttcatacagatcccctcgtggtctgagaatatgctggga

SEQ ID NO: 5480 - DNA, 468 bp, Artificial; identical to SEQ ID NO: 5089
  TaSBEIIa  allele with mutations introduced by TALEN pair TaSBEIIa_T01

SEQ ID NO: 5481 - DNA, 467 bp, Artificial; identical to SEQ ID NO: 5092
  TaSBEIIa  allele with mutations introduced by TALEN pair TaSBEIIa_T01

SEQ ID NO: 5482 - DNA, 468 bp, Artificial; identical to SEQ ID NO: 5089
  TaSBEIIa  allele with mutations introduced by TALEN pair TaSBEIIa_T01

SEQ ID NO: 5483 - DNA, 468 bp, Artificial; identical to SEQ ID NO: 5089
  TaSBEIIa  allele with mutations introduced by TALEN pair TaSBEIIa_T01

SEQ ID NO: 5484 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtccttcgtcatgcaaatttgggaacatcaaagagacaaagactagggaccactatttcttacagttcccctcatggtctgagaatatgctggga

SEQ ID NO: 5485 - DNA, 469 bp, Artificial; identical to SEQ ID NO: 5194
  TaSBEIIa  allele with mutations introduced by TALEN pair TaSBEIIa_T01

SEQ ID NO: 5486 - DNA, 468 bp, Artificial; identical to SEQ ID NO: 5089
  TaSBEIIa  allele with mutations introduced by TALEN pair TaSBEIIa_T01

SEQ ID NO: 5487 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctcgtgtctgagaatatgctggga

SEQ ID NO: 5488 - DNA, 469 bp, Artificial
  TaSBEIIa  allele with mutations introduced by TALEN pair TaSBEIIa_T01
  misc_feature (447): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtccttttcgtcatgcaaatttggggaacatcaaagagacaaagactagggaccactatttcttacagttcccctnatggtctgagaatatgctggga

SEQ ID NO: 5489 - DNA, 468 bp, Artificial; identical to SEQ ID NO: 5147
  TaSBEIIa  allele with mutations introduced by TALEN pair TaSBEIIa_T01

SEQ ID NO: 5490 - DNA, 469 bp, Artificial; identical to SEQ ID NO: 5124
  TaSBEIIa  allele with mutations introduced by TALEN pair TaSBEIIa_T01

SEQ ID NO: 5491 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctgga

SEQ ID NO: 5492 - DNA, 467 bp, Artificial
  TaSBEIIa  allele with mutations introduced by TALEN pair TaSBEIIa_T01
  misc_feature (455): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcatttgaattaaggtcctttcgtcatgcaaatttggggaacatcaaagagacaaagactagggaccactatttcttacagttcccctcatggtctganaatatgctggga

SEQ ID NO: 5493 - DNA, 469 bp, Artificial; identical to SEQ ID NO: 5194
  TaSBEIIa  allele with mutations introduced by TALEN pair TaSBEIIa_T01

SEQ ID NO: 5494 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 5495 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccagagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5496 - DNA, 468 bp, Artificial; identical to SEQ ID NO: 5091
  TaSBEIIa  allele with mutations introduced by TALEN pair TaSBEIIa_T01

SEQ ID NO: 5497 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggaagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5498 - DNA, 469 bp, Artificial
  TaSBEIIa  allele with mutations introduced by TALEN pair TaSBEIIa_T01
  misc_feature (457): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctcatggtctgganaatatgctggga

SEQ ID NO: 5499 - DNA, 469 bp, Artificial; identical to SEQ ID NO: 5084
  TaSBEIIa  allele with mutations introduced by TALEN pair TaSBEIIa_T01

SEQ ID NO: 5500 - DNA, 471 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctacccgctactttcgctcattttgaattaaggtcctttcgtcatgcaaatttggggaacatcaaagagacaaagactagggaccactatttcttacacgttcccctcatggtctgagaatatgctggga

SEQ ID NO: 5501 - DNA, 470 bp, Artificial; identical to SEQ ID NO: 5112
  TaSBEIIa  allele with mutations introduced by TALEN pair TaSBEIIa_T01

SEQ ID NO: 5502 - DNA, 473 bp, Artificial; identical to SEQ ID NO: 5209
  TaSBEIIa  allele with mutations introduced by TALEN pair TaSBEIIa_T01

SEQ ID NO: 5503 - DNA, 472 bp, Artificial; identical to SEQ ID NO: 5101
  TaSBEIIa  allele with mutations introduced by TALEN pair TaSBEIIa_T01

SEQ ID NO: 5504 - DNA, 468 bp, Artificial
  TaSBEIIa  allele with mutations introduced by TALEN pair TaSBEIIa_T01
tcagatggatgtgcattctagcaagaacttcacaaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5505 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 5506 - DNA, 443 bp, Artificial; identical to SEQ ID NO: 5106
  TaSBEIIa  allele with mutations introduced by TALEN pair TaSBEIIa_T01

SEQ ID NO: 5507 - DNA, 468 bp, Artificial; identical to SEQ ID NO: 5234
  TaSBEIIa  allele with mutations introduced by TALEN pair TaSBEIIa_T01

SEQ ID NO: 5508 - DNA, 467 bp, Artificial; identical to SEQ ID NO: 5158
  TaSBEIIa  allele with mutations introduced by TALEN pair TaSBEIIa_T01

SEQ ID NO: 5509 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgcatgcaaatttggggaacatcaaagagacaaagactagggaccactatttcttacagttcccctcatggtctgagaatatgctggga

SEQ ID NO: 5510 - DNA, 466 bp, Artificial; identical to SEQ ID NO: 5396
  TaSBEIIa  allele with mutations introduced by TALEN pair TaSBEIIa_T01

SEQ ID NO: 5511 - DNA, 462 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctaccgctactttcgctcatttgaattaaggtcctttgtcatgccaaatttgggaacatcaaagagacaaagactagggaccactatttcttacagttccctcatggtctgagaatatgctggga

SEQ ID NO: 5512 - DNA, 468 bp, Artificial; identical to SEQ ID NO: 5089
  TaSBEIIa  allele with mutations introduced by TALEN pair TaSBEIIa_T01

SEQ ID NO: 5513 - DNA, 468 bp, Artificial; identical to SEQ ID NO: 5089
  TaSBEIIa  allele with mutations introduced by TALEN pair TaSBEIIa_T01

SEQ ID NO: 5514 - DNA, 466 bp, Artificial; identical to SEQ ID NO: 5145
  TaSBEIIa  allele with mutations introduced by TALEN pair TaSBEIIa_T01

SEQ ID NO: 5515 - DNA, 468 bp, Artificial; identical to SEQ ID NO: 5091
  TaSBEIIa  allele with mutations introduced by TALEN pair TaSBEIIa_T01

SEQ ID NO: 5516 - DNA, 471 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatacaaagaggacaaagactagggaccactattcatacagttcccctcatggtctgagaatatgctga

SEQ ID NO: 5517 - DNA, 470 bp, Artificial; identical to SEQ ID NO: 5112
  TaSBEIIa  allele with mutations introduced by TALEN pair TaSBEIIa_T01

SEQ ID NO: 5518 - DNA, 470 bp, Artificial; identical to SEQ ID NO: 5203
  TaSBEIIa  allele with mutations introduced by TALEN pair TaSBEIIa_T01

SEQ ID NO: 5519 - DNA, 467 bp, Artificial; identical to SEQ ID NO: 5092
  TaSBEIIa  allele with mutations introduced by TALEN pair TaSBEIIa_T01

SEQ ID NO: 5520 - DNA, 468 bp, Artificial
  TaSBEIIa  allele with mutations introduced by TALEN pair TaSBEIIa_T01
  misc_feature (407): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttggggaacatcaaagngacaaagactagggaccactatttcttacagttcccctcatggtctgagaatatgctggga

SEQ ID NO: 5521 - DNA, 466 bp, Artificial
  TaSBEIIa  allele with mutations introduced by TALEN pair TaSBEIIa_T01
  misc_feature (444): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgctaaatttgggaacatcaaagagacaaagactagggaccactatttcttacagttcccctnatggtctgagaatatgctggga

SEQ ID NO: 5522 - DNA, 469 bp, Artificial; identical to SEQ ID NO: 5084
  TaSBEIIa  allele with mutations introduced by TALEN pair TaSBEIIa_T01

SEQ ID NO: 5523 - DNA, 468 bp, Artificial; identical to SEQ ID NO: 5146
  TaSBEIIa  allele with mutations introduced by TALEN pair TaSBEIIa_T01

SEQ ID NO: 5524 - DNA, 468 bp, Artificial
  TaSBEIIa  allele with mutations introduced by TALEN pair TaSBEIIa_T01
  misc_feature (446): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcatttgaattaaggtcctttgtcattgcaaatttggggaacatcaaaagagacaaagactagggaccactatttcttacagtttccccctnatggtctgagaatatgctggga

SEQ ID NO: 5525 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttgtcatgcaaatttggggaacatcaaagagacaaagactagggaccactatttcttacagttcccctcatggtctgagatatgctggga

SEQ ID NO: 5526 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtccttttcgtcatgcaaatttggggaacatcaaagagacaaagactagggaccactatttcttacagttcccctcatggtctgagaatatgctggga

SEQ ID NO: 5527 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctctattttgaattaaggtcctttcgtcatgcaaatttggggaacatcaaagagacaaagactagggaccactatttcttacagttcccctcatggtctgagaatatgctggga

SEQ ID NO: 5528 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctaccgctgctttcgctcattttgaattaaggtcctttcatcatgcaaatttggggaacatcaaagagacaaagactagggaccaccatttcatacagatccctcgtggtctgagaatatgctggga

SEQ ID NO: 5529 - DNA, 469 bp, Artificial; identical to SEQ ID NO: 5084
  TaSBEIIa  allele with mutations introduced by TALEN pair TaSBEIIa_T01

SEQ ID NO: 5530 - DNA, 467 bp, Artificial; identical to SEQ ID NO: 5092
  TaSBEIIa  allele with mutations introduced by TALEN pair TaSBEIIa_T01

SEQ ID NO: 5531 - DNA, 465 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaaattttcggagccatcttgactaccggtaatgcctacccgctaatttcgctcattttgaattaaggtcctttcatcatgcaaatttgggaacatcaaagaggcaaagactagggaccactattcatacagttcccctcatggtctgagaatatgctggga

SEQ ID NO: 5532 - DNA, 471 bp, Artificial
  TaSBEIIa  allele with mutations introduced by TALEN pair TaSBEIIa_T01
  misc_feature (288): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatntacgagattgacccaacactgattttcggagccatcttgactaccggtaatgcctacccgctgctttcgctcattttgaatttaaggtcctttcatcatgcaaatttggggaacatcaaagagacaaagactagggaccaccatttcatacagactccctcgtggtctgagaatatgctggga

SEQ ID NO: 5533 - DNA, 469 bp, Artificial; identical to SEQ ID NO: 5118
  TaSBEIIa  allele with mutations introduced by TALEN pair TaSBEIIa_T01

SEQ ID NO: 5534 - DNA, 466 bp, Artificial; identical to SEQ ID NO: 5277
  TaSBEIIa  allele with mutations introduced by TALEN pair TaSBEIIa_T01

SEQ ID NO: 5535 - DNA, 468 bp, Artificial; identical to SEQ ID NO: 5091
  TaSBEIIa  allele with mutations introduced by TALEN pair TaSBEIIa_T01

SEQ ID NO: 5536 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactatttcggagccatcttgactaccggtaatgcctacccgctgctttcgctcattttgaattaaggtcctttcatcatgcaaatttggggaacatcaaagagacaaagactagggaccaccattcatacagatcccctcgtggtctgagaatatgctggga

SEQ ID NO: 5537 - DNA, 470 bp, Artificial; identical to SEQ ID NO: 5203
  TaSBEIIa  allele with mutations introduced by TALEN pair TaSBEIIa_T01

SEQ ID NO: 5538 - DNA, 467 bp, Artificial; identical to SEQ ID NO: 5092
  TaSBEIIa  allele with mutations introduced by TALEN pair TaSBEIIa_T01

SEQ ID NO: 5539 - DNA, 443 bp, Artificial; identical to SEQ ID NO: 5106
  TaSBEIIa  allele with mutations introduced by TALEN pair TaSBEIIa_T01

SEQ ID NO: 5540 - DNA, 469 bp, Artificial; identical to SEQ ID NO: 5242
  TaSBEIIa  allele with mutations introduced by TALEN pair TaSBEIIa_T01

SEQ ID NO: 5541 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattcttacagttccctcatggtctgagaatatgctggga

SEQ ID NO: 5542 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactaatttcttacagttcccctcatggtctgagaatatgctggga

SEQ ID NO: 5543 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtccttttcgtcatgcaaatttggggaacatcaaagagacaaagactagggaccactattcttacagttcccctcatggtctgagaatatgctggga

SEQ ID NO: 5544 - DNA, 468 bp, Artificial; identical to SEQ ID NO: 5091
  TaSBEIIa  allele with mutations introduced by TALEN pair TaSBEIIa_T01

SEQ ID NO: 5545 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccacatttcatacagatccctcgtggtctgagaatatgctggga

SEQ ID NO: 5546 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactattttcggagccatcttgactaccggtaatgcctaccgctgctttcgctcattttgaattaaggtcctttcatcatgcaaatttggggaacatcaaagagacaaagactagggaccaccattcatacagatcccctcgtggtctgagaatatgctggga

SEQ ID NO: 5547 - DNA, 468 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaaattttcggagccatcttgactaccggtaatgcctacccgctaatttcgctcattttgaattaaggtccttttcatcatgcaaatttggggaacatcaaagaggcaaagactagggaccactatttcatacagttcccctcatggtctgagaatatgctggga

SEQ ID NO: 5548 - DNA, 468 bp, Artificial; identical to SEQ ID NO: 5091
  TaSBEIIa  allele with mutations introduced by TALEN pair TaSBEIIa_T01

SEQ ID NO: 5549 - DNA, 477 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcatttttgaattaaggtccttttcgtcatgcaaaatttggggaacatcaaaagagacaaaagactagggaccactatttcttacagttccccctcattggtctgagtaatatgactggga

SEQ ID NO: 5550 - DNA, 469 bp, Artificial; identical to SEQ ID NO: 5084
  TaSBEIIa  allele with mutations introduced by TALEN pair TaSBEIIa_T01

SEQ ID NO: 5551 - DNA, 468 bp, Artificial; identical to SEQ ID NO: 5104
  TaSBEIIa  allele with mutations introduced by TALEN pair TaSBEIIa_T01

SEQ ID NO: 5552 - DNA, 469 bp, Artificial
  TaSBEIIa  allele with mutations introduced by TALEN pair TaSBEIIa_T01
  misc_feature (446): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactattcttacagttcccctnactggtctgagaatatgctggga

SEQ ID NO: 5553 - DNA, 469 bp, Artificial; identical to SEQ ID NO: 5194
  TaSBEIIa  allele with mutations introduced by TALEN pair TaSBEIIa_T01

SEQ ID NO: 5554 - DNA, 472 bp, Artificial; identical to SEQ ID NO: 5101
  TaSBEIIa  allele with mutations introduced by TALEN pair TaSBEIIa_T01

SEQ ID NO: 5555 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactattcttacagttccctcatggtctgagaatatgctggga

SEQ ID NO: 5556 - DNA, 467 bp, Artificial
  TaSBEIIa  allele with mutations introduced by TALEN pair TaSBEIIa_T01
tcagatggagtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 5557 - DNA, 465 bp, Artificial; identical to SEQ ID NO: 5467
  TaSBEIIa  allele with mutations introduced by TALEN pair TaSBEIIa_T01

SEQ ID NO: 5558 - DNA, 471 bp, Artificial; identical to SEQ ID NO: 5258
  TaSBEIIa  allele with mutations introduced by TALEN pair TaSBEIIa_T01

SEQ ID NO: 5559 - DNA, 468 bp, Artificial; identical to SEQ ID NO: 5234
  TaSBEIIa  allele with mutations introduced by TALEN pair TaSBEIIa_T01

SEQ ID NO: 5560 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagatatgctggga

SEQ ID NO: 5561 - DNA, 468 bp, Artificial; identical to SEQ ID NO: 5091
  TaSBEIIa  allele with mutations introduced by TALEN pair TaSBEIIa_T01

SEQ ID NO: 5562 - DNA, 468 bp, Artificial; identical to SEQ ID NO: 5231
  TaSBEIIa  allele with mutations introduced by TALEN pair TaSBEIIa_T01

SEQ ID NO: 5563 - DNA, 466 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactaggaccaccatttcatacagatcccctcgtggtctgagaatatgctggga

SEQ ID NO: 5564 - DNA, 467 bp, Artificial; identical to SEQ ID NO: 5092
  TaSBEIIa  allele with mutations introduced by TALEN pair TaSBEIIa_T01

SEQ ID NO: 5565 - DNA, 472 bp, Artificial; identical to SEQ ID NO: 5101
  TaSBEIIa  allele with mutations introduced by TALEN pair TaSBEIIa_T01

SEQ ID NO: 5566 - DNA, 468 bp, Artificial; identical to SEQ ID NO: 5104
  TaSBEIIa  allele with mutations introduced by TALEN pair TaSBEIIa_T01

SEQ ID NO: 5567 - DNA, 468 bp, Artificial; identical to SEQ ID NO: 5089
  TaSBEIIa  allele with mutations introduced by TALEN pair TaSBEIIa_T01

SEQ ID NO: 5568 - DNA, 467 bp, Artificial; identical to SEQ ID NO: 5471
  TaSBEIIa  allele with mutations introduced by TALEN pair TaSBEIIa_T01

SEQ ID NO: 5569 - DNA, 467 bp, Artificial; identical to SEQ ID NO: 5092
  TaSBEIIa  allele with mutations introduced by TALEN pair TaSBEIIa_T01

SEQ ID NO: 5570 - DNA, 467 bp, Artificial; identical to SEQ ID NO: 5092
  TaSBEIIa  allele with mutations introduced by TALEN pair TaSBEIIa_T01

SEQ ID NO: 5571 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacacgttcccctcatggtctgagaatatgctggga

SEQ ID NO: 5572 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctaccgctactttcgctcattttgaattaaggtcctttcgtcattgcaaatttggggaacatcaaagagacaaagactagggaccactatttcttacagttcccctcatggtctgagaatatgct

SEQ ID NO: 5573 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagatagtgctggga

SEQ ID NO: 5574 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatccctcgtggtctgagatatgctgga

SEQ ID NO: 5575 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5576 - DNA, 465 bp, Artificial; identical to SEQ ID NO: 5531
  TaSBEIIa  allele with mutations introduced by TALEN pair TaSBEIIa_T01

SEQ ID NO: 5577 - DNA, 469 bp, Artificial; identical to SEQ ID NO: 5194
  TaSBEIIa  allele with mutations introduced by TALEN pair TaSBEIIa_T01

SEQ ID NO: 5578 - DNA, 469 bp, Artificial; identical to SEQ ID NO: 5242
  TaSBEIIa  allele with mutations introduced by TALEN pair TaSBEIIa_T01

SEQ ID NO: 5579 - DNA, 466 bp, Artificial; identical to SEQ ID NO: 5145
  TaSBEIIa  allele with mutations introduced by TALEN pair TaSBEIIa_T01

SEQ ID NO: 5580 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgatttcggagccatcttgactaccggtaatgcctacccgctactttcgctcattttgaattaaggtcctttcgtcatgcaaatttggggaacatcaaagagacaaagactagggaccactatttcttacagttcccctcatggctgagaatatgctggga

SEQ ID NO: 5581 - DNA, 465 bp, Artificial; identical to SEQ ID NO: 5531
  TaSBEIIa  allele with mutations introduced by TALEN pair TaSBEIIa_T01

SEQ ID NO: 5582 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctacttcgctcattttgaattaaggtccttcgtcatgcaaagtttggggaacatacaaagagaacaaagactagggaccactatttcttacagttcccctcatggtctgagaatatgctggga

SEQ ID NO: 5583 - DNA, 468 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcggggagaaaccgcgagttgtcccaaaaccaggagatgggcagaaaatatacgagattgacccaacgcttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 5584 - DNA, 471 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgaaatatgctggga

SEQ ID NO: 5585 - DNA, 470 bp, Artificial; identical to SEQ ID NO: 5112
  TaSBEIIa  allele with mutations introduced by TALEN pair TaSBEIIa_T01

SEQ ID NO: 5586 - DNA, 466 bp, Artificial; identical to SEQ ID NO: 5277
  TaSBEIIa  allele with mutations introduced by TALEN pair TaSBEIIa_T01

SEQ ID NO: 5587 - DNA, 468 bp, Artificial; identical to SEQ ID NO: 5091
  TaSBEIIa  allele with mutations introduced by TALEN pair TaSBEIIa_T01

SEQ ID NO: 5588 - DNA, 468 bp, Artificial
  TaSBEIIa  allele with mutations introduced by TALEN pair TaSBEIIa_T01
tcagatgatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaaacaatcactgatggtgtaaccaaaggagttaaggaactagtcgtgggggagaaaccgcgagttgtcccaaaaccaggagatgggcagaaaatatacgagattgacccaacactatttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5589 - DNA, 470 bp, Artificial; identical to SEQ ID NO: 5112
  TaSBEIIa  allele with mutations introduced by TALEN pair TaSBEIIa_T01

SEQ ID NO: 5590 - DNA, 469 bp, Artificial; identical to SEQ ID NO: 5084
  TaSBEIIa  allele with mutations introduced by TALEN pair TaSBEIIa_T01

SEQ ID NO: 5591 - DNA, 505 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgatttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggggactgggactagtcgacggacgacacacgggaggtagag

SEQ ID NO: 5592 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcaatgcaaatttggggaacatcaaagagacaaagactagggaccactatttcttacagttcccctcatggtctgagaatatgctggga

SEQ ID NO: 5593 - DNA, 467 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaaattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 5594 - DNA, 466 bp, Artificial; identical to SEQ ID NO: 5396
  TaSBEIIa  allele with mutations introduced by TALEN pair TaSBEIIa_T01

SEQ ID NO: 5595 - DNA, 468 bp, Artificial; identical to SEQ ID NO: 5091
  TaSBEIIa  allele with mutations introduced by TALEN pair TaSBEIIa_T01

SEQ ID NO: 5596 - DNA, 471 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5597 - DNA, 469 bp, Artificial; identical to SEQ ID NO: 5242
  TaSBEIIa  allele with mutations introduced by TALEN pair TaSBEIIa_T01

SEQ ID NO: 5598 - DNA, 464 bp, Artificial; identical to SEQ ID NO: 5105
  TaSBEIIa  allele with mutations introduced by TALEN pair TaSBEIIa_T01

SEQ ID NO: 5599 - DNA, 468 bp, Artificial; identical to SEQ ID NO: 5234
  TaSBEIIa  allele with mutations introduced by TALEN pair TaSBEIIa_T01

SEQ ID NO: 5600 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactatttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5601 - DNA, 464 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctaccgctactttcgctcatttgaattaaggtcctttcgtcatgcaaatttggggaacatacaaagagacaaagactagggaccactattcttacagttccctcatggtctgagaatgctggga

SEQ ID NO: 5602 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 5603 - DNA, 466 bp, Artificial
  TaSBEIIa  allele with mutations introduced by TALEN pair TaSBEIIa_T01
  misc_feature (445): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgatttcggagccatcttgactaccggtaatgcctacccgctactttcgctcattttgaattaaggtcctttcgtcatgcaaatttgggaacatcaaagagacaaagactagggaccactatttcttacagttcccctnatggtctgagatatgctggga

SEQ ID NO: 5604 - DNA, 468 bp, Artificial; identical to SEQ ID NO: 5091
  TaSBEIIa  allele with mutations introduced by TALEN pair TaSBEIIa_T01

SEQ ID NO: 5605 - DNA, 471 bp, Artificial; identical to SEQ ID NO: 5258
  TaSBEIIa  allele with mutations introduced by TALEN pair TaSBEIIa_T01

SEQ ID NO: 5606 - DNA, 466 bp, Artificial; identical to SEQ ID NO: 5145
  TaSBEIIa  allele with mutations introduced by TALEN pair TaSBEIIa_T01

SEQ ID NO: 5607 - DNA, 472 bp, Artificial; identical to SEQ ID NO: 5101
  TaSBEIIa  allele with mutations introduced by TALEN pair TaSBEIIa_T01

SEQ ID NO: 5608 - DNA, 470 bp, Artificial; identical to SEQ ID NO: 5383
  TaSBEIIa  allele with mutations introduced by TALEN pair TaSBEIIa_T01

SEQ ID NO: 5609 - DNA, 467 bp, Artificial; identical to SEQ ID NO: 5092
  TaSBEIIa  allele with mutations introduced by TALEN pair TaSBEIIa_T01

SEQ ID NO: 5610 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtccttcgtcatgcaaatttgggaacatcaaagagacaaagactagggaccactattcttacagttcccctcatggtctgagaatatgctggga

SEQ ID NO: 5611 - DNA, 468 bp, Artificial; identical to SEQ ID NO: 5089
  TaSBEIIa  allele with mutations introduced by TALEN pair TaSBEIIa_T01

SEQ ID NO: 5612 - DNA, 469 bp, Artificial; identical to SEQ ID NO: 5084
  TaSBEIIa  allele with mutations introduced by TALEN pair TaSBEIIa_T01

SEQ ID NO: 5613 - DNA, 467 bp, Artificial; identical to SEQ ID NO: 5092
  TaSBEIIa  allele with mutations introduced by TALEN pair TaSBEIIa_T01

SEQ ID NO: 5614 - DNA, 470 bp, Artificial; identical to SEQ ID NO: 5112
  TaSBEIIa  allele with mutations introduced by TALEN pair TaSBEIIa_T01

SEQ ID NO: 5615 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttgtcatgcaaatttggggaacatcaaagagacaaagactagggaccactatttcttacagttcccctcatggtctgagaatatgctggga

SEQ ID NO: 5616 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagaacaaagactagggaccactatttcttacacgttcccctcatggtctgagaatatgctggga

SEQ ID NO: 5617 - DNA, 468 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgttttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 5618 - DNA, 469 bp, Artificial; identical to SEQ ID NO: 5084
  TaSBEIIa  allele with mutations introduced by TALEN pair TaSBEIIa_T01

SEQ ID NO: 5619 - DNA, 469 bp, Artificial
  TaSBEIIa  allele with mutations introduced by TALEN pair TaSBEIIa_T01
  misc_feature (446): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctnactggtctgagaatatgctggga

SEQ ID NO: 5620 - DNA, 471 bp, Artificial; identical to SEQ ID NO: 5123
  TaSBEIIa  allele with mutations introduced by TALEN pair TaSBEIIa_T01

SEQ ID NO: 5621 - DNA, 471 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgttttcggagccatcttgactaccggtaatcgcctacccgctgctttcgctcattttgaattaaggtcctttcatcatgcaaatttggggaacatcaaagagacaaagactagggaccaccatttcatacagactcccctcgtggtctgagaatatgctggga

SEQ ID NO: 5622 - DNA, 468 bp, Artificial; identical to SEQ ID NO: 5091
  TaSBEIIa  allele with mutations introduced by TALEN pair TaSBEIIa_T01

SEQ ID NO: 5623 - DNA, 464 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtccttcgtcatgcaaatttgggaacatcaaagagacaaagactagggaccactatttcttacagttcccctcatggtctgagaatatgctggga

SEQ ID NO: 5624 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactattttcggagccatcttgactaccggtaatgcctaccgctgctttcgctcattttgaattaggtcctttcatcatgcaaatttggggaacatcaaagagacaaagactagggaccaccatttcatacagatcccctcgtggtctgagaatatgctggga

SEQ ID NO: 5625 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctacccgctactttcgctcattttgaattaaggtccttgtcatgcaaatttggggaacatcaaagagacaaagactagggaccactatttcttacagttcccctcatggtctgagaatatgctggga

SEQ ID NO: 5626 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5627 - DNA, 469 bp, Artificial; identical to SEQ ID NO: 5084
  TaSBEIIa  allele with mutations introduced by TALEN pair TaSBEIIa_T01

SEQ ID NO: 5628 - DNA, 468 bp, Artificial; identical to SEQ ID NO: 5089
  TaSBEIIa  allele with mutations introduced by TALEN pair TaSBEIIa_T01

SEQ ID NO: 5629 - DNA, 467 bp, Artificial; identical to SEQ ID NO: 5095
  TaSBEIIa  allele with mutations introduced by TALEN pair TaSBEIIa_T01

SEQ ID NO: 5630 - DNA, 468 bp, Artificial; identical to SEQ ID NO: 5089
  TaSBEIIa  allele with mutations introduced by TALEN pair TaSBEIIa_T01

SEQ ID NO: 5631 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactattcttacagttcccctcactggtctgagaatatgctggga

SEQ ID NO: 5632 - DNA, 467 bp, Artificial; identical to SEQ ID NO: 5148
  TaSBEIIa  allele with mutations introduced by TALEN pair TaSBEIIa_T01

SEQ ID NO: 5633 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgttggga

SEQ ID NO: 5634 - DNA, 468 bp, Artificial; identical to SEQ ID NO: 5146
  TaSBEIIa  allele with mutations introduced by TALEN pair TaSBEIIa_T01

SEQ ID NO: 5635 - DNA, 468 bp, Artificial; identical to SEQ ID NO: 5234
  TaSBEIIa  allele with mutations introduced by TALEN pair TaSBEIIa_T01

SEQ ID NO: 5636 - DNA, 469 bp, Artificial; identical to SEQ ID NO: 5084
  TaSBEIIa  allele with mutations introduced by TALEN pair TaSBEIIa_T01

SEQ ID NO: 5637 - DNA, 467 bp, Artificial; identical to SEQ ID NO: 5475
  TaSBEIIa  allele with mutations introduced by TALEN pair TaSBEIIa_T01

SEQ ID NO: 5638 - DNA, 468 bp, Artificial; identical to SEQ ID NO: 5234
  TaSBEIIa  allele with mutations introduced by TALEN pair TaSBEIIa_T01

SEQ ID NO: 5639 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctcactggtctgagaatatgctggga

SEQ ID NO: 5640 - DNA, 464 bp, Artificial; identical to SEQ ID NO: 5105
  TaSBEIIa  allele with mutations introduced by TALEN pair TaSBEIIa_T01

SEQ ID NO: 5641 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcatttgaattaaggtcctttcgtcattgcaaatttggggaacatcaaagagacaaagactagggaccactatttcttacagttcccctcatggtctgagaatatgctggga

SEQ ID NO: 5642 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5643 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttccctcatggtctgagatatgctggga

SEQ ID NO: 5644 - DNA, 469 bp, Artificial; identical to SEQ ID NO: 5124
  TaSBEIIa  allele with mutations introduced by TALEN pair TaSBEIIa_T01

SEQ ID NO: 5645 - DNA, 467 bp, Artificial; identical to SEQ ID NO: 5191
  TaSBEIIa  allele with mutations introduced by TALEN pair TaSBEIIa_T01

SEQ ID NO: 5646 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaatttggggaacatcaaagagacaaagactagggaccaccatttcatacagatcccctcgtggtctgagaatatgctggga

SEQ ID NO: 5647 - DNA, 467 bp, Artificial; identical to SEQ ID NO: 5092
  TaSBEIIa  allele with mutations introduced by TALEN pair TaSBEIIa_T01

SEQ ID NO: 5648 - DNA, 471 bp, Artificial; identical to SEQ ID NO: 5258
  TaSBEIIa  allele with mutations introduced by TALEN pair TaSBEIIa_T01

SEQ ID NO: 5649 - DNA, 470 bp, Artificial; identical to SEQ ID NO: 5112
  TaSBEIIa  allele with mutations introduced by TALEN pair TaSBEIIa_T01

SEQ ID NO: 5650 - DNA, 471 bp, Artificial; identical to SEQ ID NO: 5216
  TaSBEIIa  allele with mutations introduced by TALEN pair TaSBEIIa_T01

SEQ ID NO: 5651 - DNA, 461 bp, Artificial; identical to SEQ ID NO: 5198
  TaSBEIIa  allele with mutations introduced by TALEN pair TaSBEIIa_T01

SEQ ID NO: 5652 - DNA, 469 bp, Artificial; identical to SEQ ID NO: 5124
  TaSBEIIa  allele with mutations introduced by TALEN pair TaSBEIIa_T01

SEQ ID NO: 5653 - DNA, 469 bp, Artificial; identical to SEQ ID NO: 5084
  TaSBEIIa  allele with mutations introduced by TALEN pair TaSBEIIa_T01

SEQ ID NO: 5654 - DNA, 471 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaagtttggggaacatcaaagagacaaagactagggaccaccatttcatacagatcccctcgtggtctgagaatatgctggga

SEQ ID NO: 5655 - DNA, 466 bp, Artificial; identical to SEQ ID NO: 5277
  TaSBEIIa  allele with mutations introduced by TALEN pair TaSBEIIa_T01

SEQ ID NO: 5656 - DNA, 470 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgattttcggagccatcttgactaccggtaatgcctacccgctaattcgctcattttgaattaaggtcctttcatcatgcaaatttggggaacatcaaagaggcaaagactagggaccactatttcatacagttcccctcatgtctgagaatatgctggga

SEQ ID NO: 5657 - DNA, 471 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaatttaaggtcctttcatcatgcaaatttggggaacatcaaagagacaaagactagggaccaccatttcatacagatcccctcgtggtctgagaatatgctggga

SEQ ID NO: 5658 - DNA, 467 bp, Artificial; identical to SEQ ID NO: 5092
  TaSBEIIa  allele with mutations introduced by TALEN pair TaSBEIIa_T01

SEQ ID NO: 5659 - DNA, 468 bp, Artificial; identical to SEQ ID NO: 5091
  TaSBEIIa  allele with mutations introduced by TALEN pair TaSBEIIa_T01

SEQ ID NO: 5660 - DNA, 472 bp, Artificial; identical to SEQ ID NO: 5101
  TaSBEIIa  allele with mutations introduced by TALEN pair TaSBEIIa_T01

SEQ ID NO: 5661 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5662 - DNA, 468 bp, Artificial; identical to SEQ ID NO: 5234
  TaSBEIIa  allele with mutations introduced by TALEN pair TaSBEIIa_T01

SEQ ID NO: 5663 - DNA, 471 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactattttcggagccatcttgactaccggtaatgcctacccgctgctttcgctcattttgaattaaggtcctttcatcatgcaaatttggggaacatacaaagagacaaagactagggaccaccatttcatacagatcccctcgtggtctgagtaatatgctggga

SEQ ID NO: 5664 - DNA, 460 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgccatcttgactaccggtaatgcctacccgctaatttcgctcattttgaattaaggtcctttcatcatgcaaatttgggaacatcaaagagcaaagactagggaccactatttcatacagttcccctcatggtctgagaatatgctggga

SEQ ID NO: 5665 - DNA, 469 bp, Artificial; identical to SEQ ID NO: 5084
  TaSBEIIa  allele with mutations introduced by TALEN pair TaSBEIIa_T01

SEQ ID NO: 5666 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctaccgctactttcgctcattttgaattaaggtcctttcgtcatgcaaatttgggaacatcaaagagacaaagactagggaccactattcttacagttcccctcatggtctgagaatatgctggga

SEQ ID NO: 5667 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacagattttcggagccatcttgactaccggtaatgcctacccgctgctttcgctcattttgaattaaggtcctttcatcatgcaaatttggggaacatcaaagagacaaagactagggaccaccatttcatacagatccctcgtggtctgagaatatgctggga

SEQ ID NO: 5668 - DNA, 468 bp, Artificial
  TaSBEIIa  allele with mutations introduced by TALEN pair TaSBEIIa_T01
  misc_feature (446): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttgggaacatcaaagagacaaagactagggaccacgtatttcttacagttcccctnatggtctgagaatatgctggga

SEQ ID NO: 5669 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 5670 - DNA, 470 bp, Artificial; identical to SEQ ID NO: 5112
  TaSBEIIa  allele with mutations introduced by TALEN pair TaSBEIIa_T01

SEQ ID NO: 5671 - DNA, 467 bp, Artificial
  TaSBEIIa  allele with mutations introduced by TALEN pair TaSBEIIa_T01
  misc_feature (222): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggngttaaggaactagtcgtgggggagaaaccgcgagttgtcccaaaaccaggagatgggcagaaaatatacgagattgacccaacactgtttcggagccatcttgactaccggtaatgcctacccgctgctttcgctcattttgaattaaggtcctttcatcatgcaaatttggggaacatcaaagagacaaagactagggaccacatttcatacagatcccctcgtggtctgagaatatgctggga

SEQ ID NO: 5672 - DNA, 467 bp, Artificial; identical to SEQ ID NO: 5092
  TaSBEIIa  allele with mutations introduced by TALEN pair TaSBEIIa_T01

SEQ ID NO: 5673 - DNA, 468 bp, Artificial; identical to SEQ ID NO: 5147
  TaSBEIIa  allele with mutations introduced by TALEN pair TaSBEIIa_T01

SEQ ID NO: 5674 - DNA, 474 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctctcggtctgtagaatatagcgtgggta

SEQ ID NO: 5675 - DNA, 468 bp, Artificial; identical to SEQ ID NO: 5147
  TaSBEIIa  allele with mutations introduced by TALEN pair TaSBEIIa_T01

SEQ ID NO: 5676 - DNA, 471 bp, Artificial; identical to SEQ ID NO: 5216
  TaSBEIIa  allele with mutations introduced by TALEN pair TaSBEIIa_T01

SEQ ID NO: 5677 - DNA, 471 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctaggga

SEQ ID NO: 5678 - DNA, 469 bp, Artificial; identical to SEQ ID NO: 5242
  TaSBEIIa  allele with mutations introduced by TALEN pair TaSBEIIa_T01

SEQ ID NO: 5679 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaaatgcctacccgctgctttcgctcattttgaattaaaggtcctttcatcatgcaaatttggggaacatcaaagagacaaagactagggaccaccatttcatacagatcccctcgtggtctgagaatatgctggga

SEQ ID NO: 5680 - DNA, 468 bp, Artificial
  TaSBEIIa  allele with mutations introduced by TALEN pair TaSBEIIa_T01
  misc_feature (347): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgatttcggagccatcttgactaccggtaatgcctacccgntactttcgctcattttgaattaaggtcctttcgtcatgcaaatttggggaacatcaaagagacaaagactagggaccactatttcttacagttcccctcatggtctgagaatatgctggga

SEQ ID NO: 5681 - DNA, 467 bp, Artificial; identical to SEQ ID NO: 5092
  TaSBEIIa  allele with mutations introduced by TALEN pair TaSBEIIa_T01

SEQ ID NO: 5682 - DNA, 472 bp, Artificial; identical to SEQ ID NO: 5101
  TaSBEIIa  allele with mutations introduced by TALEN pair TaSBEIIa_T01

SEQ ID NO: 5683 - DNA, 468 bp, Artificial; identical to SEQ ID NO: 5089
  TaSBEIIa  allele with mutations introduced by TALEN pair TaSBEIIa_T01

SEQ ID NO: 5684 - DNA, 466 bp, Artificial; identical to SEQ ID NO: 5145
  TaSBEIIa  allele with mutations introduced by TALEN pair TaSBEIIa_T01

SEQ ID NO: 5685 - DNA, 467 bp, Artificial; identical to SEQ ID NO: 5092
  TaSBEIIa  allele with mutations introduced by TALEN pair TaSBEIIa_T01

SEQ ID NO: 5686 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcattttgaattaaggtcctttcatcatgcaaatttggggaacatcaaagagacaaagactagggaccacatttcatacagatcccctcgtggtctgagaatatgctggga

SEQ ID NO: 5687 - DNA, 468 bp, Artificial; identical to SEQ ID NO: 5234
  TaSBEIIa  allele with mutations introduced by TALEN pair TaSBEIIa_T01

SEQ ID NO: 5688 - DNA, 471 bp, Artificial; identical to SEQ ID NO: 5216
  TaSBEIIa  allele with mutations introduced by TALEN pair TaSBEIIa_T01

SEQ ID NO: 5689 - DNA, 467 bp, Artificial; identical to SEQ ID NO: 5593
  TaSBEIIa  allele with mutations introduced by TALEN pair TaSBEIIa_T01

SEQ ID NO: 5690 - DNA, 469 bp, Artificial; identical to SEQ ID NO: 5357
  TaSBEIIa  allele with mutations introduced by TALEN pair TaSBEIIa_T01

SEQ ID NO: 5691 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcatttgaattaaggtcctttcatcatgcaaatttggggaacatcaaagagacaaagactagggaccaccatttcatacagatcccctcgtggtctgagaatatgctggga

SEQ ID NO: 5692 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaaatatacgagattgacccaacgctgttttcggagccatcttgactaccggtaatgcctacccgctactttcgctcattttgaattaaggtcctttcgtcatgcaaatttggggaaacatcaaagagacaaagactagggacactattcttacagttcccctcatggtctgagaatatgctggga

SEQ ID NO: 5693 - DNA, 470 bp, Artificial; identical to SEQ ID NO: 5112
  TaSBEIIa  allele with mutations introduced by TALEN pair TaSBEIIa_T01

SEQ ID NO: 5694 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctacttttcgctcattttgaattaaggtcctttcgtcatgcaaatttggggaacatcaaagagacaaagactagggaccactattcttacagttcccctcatggtctgagaatatgctggga

SEQ ID NO: 5695 - DNA, 468 bp, Artificial; identical to SEQ ID NO: 5234
  TaSBEIIa  allele with mutations introduced by TALEN pair TaSBEIIa_T01

SEQ ID NO: 5696 - DNA, 509 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtccaaaaccaggagatgggcagaaaatatacgagattgacccaacaggcgctggagacggtccagcggctgttgccggtgctgtgccaggcccacggcttgaccccccagcaggtggtggccattgctggccatcttgactaccggtaatgcctacccgctgctttcgctcattttgaattaaggtcctttcatcatgcaaatttggggaacatcaaagagacaaagactagggaccaccatttcattaa

SEQ ID NO: 5697 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctatttttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 5698 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctttttcggagccatcttgactaccggtaatgcctacccgctactttcgctcatttgaattaaggtctttcgtcatgcaaatttgggaacatcaaagagacaaagactagggaccactaatttcttacagttcccctcatggtctgagaatatgctggga

SEQ ID NO: 5699 - DNA, 468 bp, Artificial; identical to SEQ ID NO: 5359
  TaSBEIIa  allele with mutations introduced by TALEN pair TaSBEIIa_T01

SEQ ID NO: 5700 - DNA, 466 bp, Artificial
  TaSBEIIa  allele with mutations introduced by TALEN pair TaSBEIIa_T01
  misc_feature (443): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctacttcgctcattttgaattaaggtcctttcgtcatgcaaatttgggaacatcaaagagacaaagactagggaccactatttctacagttcccctnatggtctgagaatatgactggga

SEQ ID NO: 5701 - DNA, 467 bp, Artificial; identical to SEQ ID NO: 5555
  TaSBEIIa  allele with mutations introduced by TALEN pair TaSBEIIa_T01

SEQ ID NO: 5702 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacagtcaaagagacaaagactagggaccaccatttcatacagatcccctcgtggtctgagaatatgctggga

SEQ ID NO: 5703 - DNA, 470 bp, Artificial; identical to SEQ ID NO: 5203
  TaSBEIIa  allele with mutations introduced by TALEN pair TaSBEIIa_T01

SEQ ID NO: 5704 - DNA, 467 bp, Artificial; identical to SEQ ID NO: 5092
  TaSBEIIa  allele with mutations introduced by TALEN pair TaSBEIIa_T01

SEQ ID NO: 5705 - DNA, 471 bp, Artificial; identical to SEQ ID NO: 5123
  TaSBEIIa  allele with mutations introduced by TALEN pair TaSBEIIa_T01

SEQ ID NO: 5706 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctaccgctgctttcgctcattttgaattaaggtcctttcatcatgcaaatttggggaacatcaaagagacaaagactagggaccaccatttcatacagatcccctcgtcggtctgagaatatgctggga

SEQ ID NO: 5707 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctacttcgctcattttgaattaaggtcctttcgtcatgcaaatttggggaacatcaaagagacaaagactagggaccactatttcttacagttcccctcatggtctgagaatatgctggga

SEQ ID NO: 5708 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttaacagttccccctcatggtctgagaatatgctggga

SEQ ID NO: 5709 - DNA, 467 bp, Artificial; identical to SEQ ID NO: 5092
  TaSBEIIa  allele with mutations introduced by TALEN pair TaSBEIIa_T01

SEQ ID NO: 5710 - DNA, 467 bp, Artificial; identical to SEQ ID NO: 5092
  TaSBEIIa  allele with mutations introduced by TALEN pair TaSBEIIa_T01

SEQ ID NO: 5711 - DNA, 462 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcatttgaattaaggtcctttcgtcatgcaaatttgggaacatcaaagagacaaagactagggaccactattcttacagttcccctcatggtctgagatatgctggga

SEQ ID NO: 5712 - DNA, 467 bp, Artificial; identical to SEQ ID NO: 5092
  TaSBEIIa  allele with mutations introduced by TALEN pair TaSBEIIa_T01

SEQ ID NO: 5713 - DNA, 438 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtccaaaaccaggagatgggcagaaaatatacgccatcttgactaccggtaatgcctaccgctgctttcgctcattttgaattaaggtcctttcatcatgcaaattttgggaacatcaagagacaaagactagggaccaccatttcatacagatccctcgtggtctgagatatgctggga

SEQ ID NO: 5714 - DNA, 471 bp, Artificial
  TaSBEIIa  allele with mutations introduced by TALEN pair TaSBEIIa_T01
  misc_feature (382): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctattttcggagccatcttgactaccggtaatgcctacccgctaatttcgctcattttgaattaaggtcctttnatcatgcaaatttggggaacatcaaagaggacaaagactagggaccactatttcatacagttcccctcatggtctgagatatgctggga

SEQ ID NO: 5715 - DNA, 470 bp, Artificial; identical to SEQ ID NO: 5112
  TaSBEIIa  allele with mutations introduced by TALEN pair TaSBEIIa_T01

SEQ ID NO: 5716 - DNA, 468 bp, Artificial; identical to SEQ ID NO: 5089
  TaSBEIIa  allele with mutations introduced by TALEN pair TaSBEIIa_T01

SEQ ID NO: 5717 - DNA, 466 bp, Artificial; identical to SEQ ID NO: 5145
  TaSBEIIa  allele with mutations introduced by TALEN pair TaSBEIIa_T01

SEQ ID NO: 5718 - DNA, 463 bp, Artificial
  TaSBEIIa  allele with mutations introduced by TALEN pair TaSBEIIa_T01
  misc_feature (287): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatntacgagattgacccaacgctgattttcggagccatcttgactaccggtaatgcctaccgctactttcgctcatttgaattaaggtccttcgtcatgcaaatttgggaacatcaaagagacaaagactagggaccactattcttacagttcccctcatggtctgagaatatgctgga

SEQ ID NO: 5719 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcattttgaattaaggtcctttcatcatgcaaatttggggaacatcaaagagacaaagactagggaccaccatttcatacagatacccctcgtggtctgagaatatgctggga

SEQ ID NO: 5720 - DNA, 472 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgttttcggagccatcttgactaccggtaatgcctacccgctaatttcgctcattttgaattaaggtcctttcatcatgcaaatttggggaacatcaaagaggacaaagactagggaccactatttcatacagttcccctcatggtctgagaatatgctggga

SEQ ID NO: 5721 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 5722 - DNA, 469 bp, Artificial
  TaSBEIIa  allele with mutations introduced by TALEN pair TaSBEIIa_T01
  misc_feature (447): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctnatggtctgagaatatgctggga

SEQ ID NO: 5723 - DNA, 467 bp, Artificial; identical to SEQ ID NO: 5092
  TaSBEIIa  allele with mutations introduced by TALEN pair TaSBEIIa_T01

SEQ ID NO: 5724 - DNA, 466 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaaattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 5725 - DNA, 472 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttacccctcatggtctgagatatgctggga

SEQ ID NO: 5726 - DNA, 468 bp, Artificial; identical to SEQ ID NO: 5231
  TaSBEIIa  allele with mutations introduced by TALEN pair TaSBEIIa_T01

SEQ ID NO: 5727 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctatttcggagccatcttgactaccggtaatgcctacccgctactttcgctcattttgaattaaggtccttttcgtcatgcaaatttggggaacatcaaagagacaaagactagggaccactatttcttacagttcccctcatggtctgagaatatgctggga

SEQ ID NO: 5728 - DNA, 469 bp, Artificial; identical to SEQ ID NO: 5619
  TaSBEIIa  allele with mutations introduced by TALEN pair TaSBEIIa_T01
  misc_feature (446): n is a or c or t or g

SEQ ID NO: 5729 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaaattaaggtcctttcgtcatgcaaatttggggaacatcaaagagacaaagactagggaccactatttcttacagttcccctcatggtctgagaatatgctggga

SEQ ID NO: 5730 - DNA, 468 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgcttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctgga

SEQ ID NO: 5731 - DNA, 469 bp, Artificial; identical to SEQ ID NO: 5099
  TaSBEIIa  allele with mutations introduced by TALEN pair TaSBEIIa_T01

SEQ ID NO: 5732 - DNA, 468 bp, Artificial; identical to SEQ ID NO: 5089
  TaSBEIIa  allele with mutations introduced by TALEN pair TaSBEIIa_T01

SEQ ID NO: 5733 - DNA, 470 bp, Artificial; identical to SEQ ID NO: 5112
  TaSBEIIa  allele with mutations introduced by TALEN pair TaSBEIIa_T01

SEQ ID NO: 5734 - DNA, 467 bp, Artificial; identical to SEQ ID NO: 5092
  TaSBEIIa  allele with mutations introduced by TALEN pair TaSBEIIa_T01

SEQ ID NO: 5735 - DNA, 469 bp, Artificial; identical to SEQ ID NO: 5194
  TaSBEIIa  allele with mutations introduced by TALEN pair TaSBEIIa_T01

SEQ ID NO: 5736 - DNA, 469 bp, Artificial; identical to SEQ ID NO: 5088
  TaSBEIIa  allele with mutations introduced by TALEN pair TaSBEIIa_T01

SEQ ID NO: 5737 - DNA, 468 bp, Artificial; identical to SEQ ID NO: 5288
  TaSBEIIa  allele with mutations introduced by TALEN pair TaSBEIIa_T01

SEQ ID NO: 5738 - DNA, 467 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgttttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 5739 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctaccgctactttcgctcattttgaattaaggtcctttcgtcatgcaaatttggggaacatcaaagagacaaagactagggaccactatttcttacagttccctcatggtctgagaatatgctggga

SEQ ID NO: 5740 - DNA, 472 bp, Artificial; identical to SEQ ID NO: 5101
  TaSBEIIa  allele with mutations introduced by TALEN pair TaSBEIIa_T01

SEQ ID NO: 5741 - DNA, 473 bp, Artificial; identical to SEQ ID NO: 5179
  TaSBEIIa  allele with mutations introduced by TALEN pair TaSBEIIa_T01

SEQ ID NO: 5742 - DNA, 467 bp, Artificial; identical to SEQ ID NO: 5168
  TaSBEIIa  allele with mutations introduced by TALEN pair TaSBEIIa_T01

SEQ ID NO: 5743 - DNA, 470 bp, Artificial; identical to SEQ ID NO: 5112
  TaSBEIIa  allele with mutations introduced by TALEN pair TaSBEIIa_T01

SEQ ID NO: 5744 - DNA, 471 bp, Artificial; identical to SEQ ID NO: 5258
  TaSBEIIa  allele with mutations introduced by TALEN pair TaSBEIIa_T01

SEQ ID NO: 5745 - DNA, 468 bp, Artificial; identical to SEQ ID NO: 5089
  TaSBEIIa  allele with mutations introduced by TALEN pair TaSBEIIa_T01

SEQ ID NO: 5746 - DNA, 468 bp, Artificial; identical to SEQ ID NO: 5234
  TaSBEIIa  allele with mutations introduced by TALEN pair TaSBEIIa_T01

SEQ ID NO: 5747 - DNA, 468 bp, Artificial; identical to SEQ ID NO: 5104
  TaSBEIIa  allele with mutations introduced by TALEN pair TaSBEIIa_T01

SEQ ID NO: 5748 - DNA, 461 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcatttgaattaaggtcctttcgtcatgcaaatttgggaacatcaagagacaaagactagggaccactattcttacagttccctcatggtctgagaatatgctggga

SEQ ID NO: 5749 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttggggaacatcaaagagaacaaagactagggaccactatttcttacagttcccctcatggtctgagaatatgctggga

SEQ ID NO: 5750 - DNA, 472 bp, Artificial
  TaSBEIIa  allele with mutations introduced by TALEN pair TaSBEIIa_T01
  misc_feature (449): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaaccaaaggagttaaggaactagtcgcgggggagaaaccgcgagttgtcccaaaaccaggagatgggcagaaaatatacgagattgacccaacgctgattttcggagccatcttgactaccggtaatgcctacccgctaattcgctcattttgaattaaggtccttcatcatgcaaatttggggaacatcaaagaggcaaagactagggaccactatttcatacagttcccctnactggtctgagaatatgctggga

SEQ ID NO: 5751 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattcggagccatcttgactaccggtaatgcctacccgctactttcgctcattttgaattaaggtcctttcgtcatgcaaatttggggaacatcaaagagacaaagactagggaccactatttattacagttcccctcatggtctgagaatatgctggga

SEQ ID NO: 5752 - DNA, 466 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaagagacaaagactagggaccaccatttcatacagatcccctcgtggtctgagaatatgctggga

SEQ ID NO: 5753 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactatttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 5754 - DNA, 467 bp, Artificial; identical to SEQ ID NO: 5148
  TaSBEIIa  allele with mutations introduced by TALEN pair TaSBEIIa_T01

SEQ ID NO: 5755 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgaagaatatgctggga

SEQ ID NO: 5756 - DNA, 472 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaaccaaaggagttaaggaactagtcgtgggggagaaaccgcgagttgtcccaaaaccaggagatgggcagaaaatatacgagattgacccaacacagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgaagaatatgctggga

SEQ ID NO: 5757 - DNA, 471 bp, Artificial; identical to SEQ ID NO: 5657
  TaSBEIIa  allele with mutations introduced by TALEN pair TaSBEIIa_T01

SEQ ID NO: 5758 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagactccctcgtgtctgagaatatgctggga

SEQ ID NO: 5759 - DNA, 466 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcatttgaattaaggtcctttcatcatgcaaatttggggaacatcaaagagacaaagactagggaccaccatttcatacagatcccctcgtggtctgagaatatgctggga

SEQ ID NO: 5760 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcatttgaattaaggtcctttcgtcatgcaaatttggggaacatcaaagagacaaagactagggaccactattcttacagttccctcatggtctgagaatatgctggga

SEQ ID NO: 5761 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgatttcggagccatcttgactaccggtaatgcctacccgctactttcgctcattttgaattaaggtcctttgtcatgcaaatttggggaacatcaaagagacaaagactagggaccactatttcttacagttcccctcatggtctgagaatatgctggga

SEQ ID NO: 5762 - DNA, 463 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactcggagccatcttgactaccggtaatgcctacccgctgctttcgctcattttgaattaaggtcctttcatcatgcaaatttggggaacatcaaagagacaaagactagggaccaccatttcatacagatcccctcgtgtctgagaatatgctggga

SEQ ID NO: 5763 - DNA, 465 bp, Artificial
  TaSBEIIa  allele with mutations introduced by TALEN pair TaSBEIIa_T01
  misc_feature (221): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggngttaaggaactagtcgtgggggagaaaccgcgagttgtcccaaaaccaggagatgggcagaaaatatacgagattgacccaacgctgaattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgct

SEQ ID NO: 5764 - DNA, 468 bp, Artificial; identical to SEQ ID NO: 5089
  TaSBEIIa  allele with mutations introduced by TALEN pair TaSBEIIa_T01

SEQ ID NO: 5765 - DNA, 467 bp, Artificial; identical to SEQ ID NO: 5092
  TaSBEIIa  allele with mutations introduced by TALEN pair TaSBEIIa_T01

SEQ ID NO: 5766 - DNA, 468 bp, Artificial; identical to SEQ ID NO: 5091
  TaSBEIIa  allele with mutations introduced by TALEN pair TaSBEIIa_T01

SEQ ID NO: 5767 - DNA, 467 bp, Artificial; identical to SEQ ID NO: 5095
  TaSBEIIa  allele with mutations introduced by TALEN pair TaSBEIIa_T01

SEQ ID NO: 5768 - DNA, 466 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagatatgctggga

SEQ ID NO: 5769 - DNA, 472 bp, Artificial; identical to SEQ ID NO: 5101
  TaSBEIIa  allele with mutations introduced by TALEN pair TaSBEIIa_T01

SEQ ID NO: 5770 - DNA, 465 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctaccgctgctttcgctcattttgaattaaggtcctttcatcatgcaaatttggggaacatcaaagagacaaagactagggaccacatttcatacagatcccctcgtggtctgagaatatgctggga

SEQ ID NO: 5771 - DNA, 467 bp, Artificial; identical to SEQ ID NO: 5669
  TaSBEIIa  allele with mutations introduced by TALEN pair TaSBEIIa_T01

SEQ ID NO: 5772 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgattaaggtcctttcgtcatgcaaatttggggaacatcaaagagacaaagactagggaccactatttcttacagttcccctcatggtctgagaatatgctggga

SEQ ID NO: 5773 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttgctcattttgaattaaggtcctttcgtcatgcaaatttggggaacatcaaagagacaaagactagggaccactatttcttacagttcccctcatggtctgagaatatgctggga

SEQ ID NO: 5774 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaataatgcgtggga

SEQ ID NO: 5775 - DNA, 464 bp, Artificial; identical to SEQ ID NO: 5246
  TaSBEIIa  allele with mutations introduced by TALEN pair TaSBEIIa_T01

SEQ ID NO: 5776 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttccccctcatggtctgagaatatgctggga

SEQ ID NO: 5777 - DNA, 469 bp, Artificial; identical to SEQ ID NO: 5084
  TaSBEIIa  allele with mutations introduced by TALEN pair TaSBEIIa_T01

SEQ ID NO: 5778 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccatttcatacagactcccctcgtggtctgagaataatgctggga

SEQ ID NO: 5779 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaaggtcctttcgtcatgcaaatttgggaacatcaaagagacaaagactagggaccactatttcttacagttcccctcatggtctgagaatatgctggga

SEQ ID NO: 5780 - DNA, 466 bp, Artificial; identical to SEQ ID NO: 5247
  TaSBEIIa  allele with mutations introduced by TALEN pair TaSBEIIa_T01

SEQ ID NO: 5781 - DNA, 465 bp, Artificial; identical to SEQ ID NO: 5289
  TaSBEIIa  allele with mutations introduced by TALEN pair TaSBEIIa_T01

SEQ ID NO: 5782 - DNA, 468 bp, Artificial; identical to SEQ ID NO: 5231
  TaSBEIIa  allele with mutations introduced by TALEN pair TaSBEIIa_T01

SEQ ID NO: 5783 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctatttcggagccatcttgactaccggtaatgcctacccgctactttcgctcattttgaattaaggtccttttcgcatgcaaatttggggaacatcaaagagacaaagactagggaccactatttcttacagttcccctcatggtctgagaatatgctggga

SEQ ID NO: 5784 - DNA, 469 bp, Artificial; identical to SEQ ID NO: 5084
  TaSBEIIa  allele with mutations introduced by TALEN pair TaSBEIIa_T01

SEQ ID NO: 5785 - DNA, 471 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcaagaaaatatacgagattgacccaacacttttcggagccatcttgactaccggtaatgcctacccgctgctttcgctcattttgaatttaaggtcctttcatcatgcaaatttggggaacatcaaagagacaaagactagggaccaccatttcatacagactcccctcgtggtctgaagaatatgctggga

SEQ ID NO: 5786 - DNA, 469 bp, Artificial; identical to SEQ ID NO: 5084
  TaSBEIIa  allele with mutations introduced by TALEN pair TaSBEIIa_T01

SEQ ID NO: 5787 - DNA, 468 bp, Artificial; identical to SEQ ID NO: 5091
  TaSBEIIa  allele with mutations introduced by TALEN pair TaSBEIIa_T01

SEQ ID NO: 5788 - DNA, 467 bp, Artificial; identical to SEQ ID NO: 5092
  TaSBEIIa  allele with mutations introduced by TALEN pair TaSBEIIa_T01

SEQ ID NO: 5789 - DNA, 470 bp, Artificial; identical to SEQ ID NO: 5112
  TaSBEIIa  allele with mutations introduced by TALEN pair TaSBEIIa_T01

SEQ ID NO: 5790 - DNA, 473 bp, Artificial
  TaSBEIIa  allele with mutations introduced by TALEN pair TaSBEIIa_T01
  misc_feature (451): n is a or c or t or g
tcagatggatgtgcattctagcaagaacttcacaaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttcccctnatggtctgagaatatgctggga

SEQ ID NO: 5791 - DNA, 471 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaaagagacaaagactagggaccactattcttacagttccctcatggtctgagaatatgctggga

SEQ ID NO: 5792 - DNA, 468 bp, Artificial; identical to SEQ ID NO: 5147
  TaSBEIIa  allele with mutations introduced by TALEN pair TaSBEIIa_T01

SEQ ID NO: 5793 - DNA, 463 bp, Artificial
  TaSBEIIa  allele with mutations introduced by TALEN pair TaSBEIIa_T01
  misc_feature (443): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctacccgctacttcgctcattttgaattaaggtcctttcgtcatgcaaatttgggaacatcaaagagacaaagactagggacactattctacagttcccctnatggtctgagatatgctgga

SEQ ID NO: 5794 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttaccctcatggtctgagatatgctggga

SEQ ID NO: 5795 - DNA, 468 bp, Artificial; identical to SEQ ID NO: 5089
  TaSBEIIa  allele with mutations introduced by TALEN pair TaSBEIIa_T01

SEQ ID NO: 5796 - DNA, 466 bp, Artificial
  TaSBEIIa  allele with mutations introduced by TALEN pair TaSBEIIa_T01
  misc_feature (345): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgcccaaaaccaggagatgggcagaaaatatacgagattgacccaacgctatttcggagccatcttgactaccggtaatgcctacccgntactttcgctcatttgaattaaggtcctttcgtcatgcaaatttggggaacatcaaagagacaaaagactagggaccactatttcttacagttcccctcatggtctgagaatatgctggga

SEQ ID NO: 5797 - DNA, 465 bp, Artificial
  TaSBEIIa  allele with mutations introduced by TALEN pair TaSBEIIa_T01
  misc_feature (347): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgntactttcgctcattttgaattaggtccttgtcatgcaaatttggggaacatcaaagagacaaagactagggaccactatttcttacagttcccctcatggtctgagaatatgctggga

SEQ ID NO: 5798 - DNA, 471 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccattttgactaccggtaatgcctacccgctactttcgctcattttgaattaaggtcctttcgtcatgcaaatttggggaacatcaaaagagacaaagactagggaccactatttcttacagttcccctcatggtctgagaatatgctggga

SEQ ID NO: 5799 - DNA, 465 bp, Artificial; identical to SEQ ID NO: 5289
  TaSBEIIa  allele with mutations introduced by TALEN pair TaSBEIIa_T01

SEQ ID NO: 5800 - DNA, 469 bp, Artificial; identical to SEQ ID NO: 5084
  TaSBEIIa  allele with mutations introduced by TALEN pair TaSBEIIa_T01

SEQ ID NO: 5801 - DNA, 468 bp, Artificial; identical to SEQ ID NO: 5091
  TaSBEIIa  allele with mutations introduced by TALEN pair TaSBEIIa_T01

SEQ ID NO: 5802 - DNA, 468 bp, Artificial; identical to SEQ ID NO: 5089
  TaSBEIIa  allele with mutations introduced by TALEN pair TaSBEIIa_T01

SEQ ID NO: 5803 - DNA, 468 bp, Artificial; identical to SEQ ID NO: 5089
  TaSBEIIa  allele with mutations introduced by TALEN pair TaSBEIIa_T01

SEQ ID NO: 5804 - DNA, 468 bp, Artificial; identical to SEQ ID NO: 5602
  TaSBEIIa  allele with mutations introduced by TALEN pair TaSBEIIa_T01

SEQ ID NO: 5805 - DNA, 467 bp, Artificial; identical to SEQ ID NO: 5526
  TaSBEIIa  allele with mutations introduced by TALEN pair TaSBEIIa_T01

SEQ ID NO: 5806 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgaattttcggagccatcttgactaccggtaatgcctacccgctgctttcgctcattttgaattaaggtcctttcatcatgcaaatttggggaacatcaaagagacaaagactagggaccaccattcatacagatcccctcgtggtctgagaatatgctggga

SEQ ID NO: 5807 - DNA, 471 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5808 - DNA, 468 bp, Artificial; identical to SEQ ID NO: 5083
  TaSBEIIa  allele with mutations introduced by TALEN pair TaSBEIIa_T01

SEQ ID NO: 5809 - DNA, 468 bp, Artificial; identical to SEQ ID NO: 5083
  TaSBEIIa  allele with mutations introduced by TALEN pair TaSBEIIa_T01

SEQ ID NO: 5810 - DNA, 468 bp, Artificial; identical to SEQ ID NO: 5089
  TaSBEIIa  allele with mutations introduced by TALEN pair TaSBEIIa_T01

SEQ ID NO: 5811 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctaactttcgctcattttcgaattaaggtcctttcgtcatgcaaatttggggaacatcaaagagacaaagactagggaccactattcttacagttccctcatggtctgagaatatgctggga

SEQ ID NO: 5812 - DNA, 470 bp, Artificial; identical to SEQ ID NO: 5112
  TaSBEIIa  allele with mutations introduced by TALEN pair TaSBEIIa_T01

SEQ ID NO: 5813 - DNA, 468 bp, Artificial; identical to SEQ ID NO: 5089
  TaSBEIIa  allele with mutations introduced by TALEN pair TaSBEIIa_T01

SEQ ID NO: 5814 - DNA, 467 bp, Artificial; identical to SEQ ID NO: 5475
  TaSBEIIa  allele with mutations introduced by TALEN pair TaSBEIIa_T01

SEQ ID NO: 5815 - DNA, 466 bp, Artificial
  TaSBEIIa  allele with mutations introduced by TALEN pair TaSBEIIa_T01
tcagatagatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5816 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcattgcaaatttgggaacatcaaagagacaaagactagggaccactatttcttacagttcccctcatggtctgagaatatgctggga

SEQ ID NO: 5817 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagatatcgaggagcaaacggctgaagtaaacatgacaggggggactgcagaaaaacttgaatcttcagaaccgactcaaggcattgtggaaacaatcactgatggtgtaaccaaggagttaaggaactagtcgtgggggagaaaccgcgagttgtcccaaaaccaggagatgggcagaaaatatacgagattgacccaacgctgaattttcggagccatcttgactaccggtaatgcctacccgctactttcgctcattttgaattaaggtcctttcgtcatgcaaatttggggaacagtcaaagagacaaagactagggaccactatttcttacagttcccctcatggtctgagatatgctggga

SEQ ID NO: 5818 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgcttcattttgaatttaaggtcctttcatcatgcaaatttggggaacatcaaagagaacaaagactagggaccaccatttcatacagatcccctcgtggtctgagaatatgctggga

SEQ ID NO: 5819 - DNA, 471 bp, Artificial; identical to SEQ ID NO: 5258
  TaSBEIIa  allele with mutations introduced by TALEN pair TaSBEIIa_T01

SEQ ID NO: 5820 - DNA, 471 bp, Artificial
  TaSBEIIa  allele with mutations introduced by TALEN pair TaSBEIIa_T01
tcagatggatgtgcattctagcaagaacttcacaaacataatgcaccgtttggggtttcgtcagtctgctctacaattgctatttttcgtgctgtagatacctgaagatatcgaggagcaaacggcggaagtgaacatgacaggggggactggcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcattttgaattaaggtcctttcatcatgcaaatttggggaacatcaaagagacaaagactagggaccaccatttcatacagatcccctcgtcggtctgagaatatgctggga

SEQ ID NO: 5821 - DNA, 468 bp, Artificial
  TaSBEIIa  allele with mutations introduced by TALEN pair TaSBEIIa_T01
  misc_feature (446): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctnatggtctgagaatatgctggga

SEQ ID NO: 5822 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctttttcggagccatcttgactaccggtaatgcctacccgctactttcgctcattttgaattaaggtcctttcgtcattgcaaatttggggaacatcaaagagacaaagactagggaccactatttcttacagttcccctcatggtctgagaatatgctggga

SEQ ID NO: 5823 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgatttcggagccatcttgactaccggtaatgcctacccgctactttcgctcattttgaattaaggttcctttcgtcattgcaaatttggggaacatcaaagagacaaagactagggaccactatttcttacagttcccctcatggtctgagaatatgctggga

SEQ ID NO: 5824 - DNA, 469 bp, Artificial; identical to SEQ ID NO: 5143
  TaSBEIIa  allele with mutations introduced by TALEN pair TaSBEIIa_T01

SEQ ID NO: 5825 - DNA, 467 bp, Artificial; identical to SEQ ID NO: 5092
  TaSBEIIa  allele with mutations introduced by TALEN pair TaSBEIIa_T01

SEQ ID NO: 5826 - DNA, 470 bp, Artificial
  TaSBEIIa  allele with mutations introduced by TALEN pair TaSBEIIa_T01
cagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaaccatttcatacagatcccctcgtggtctgagaatatgctggga

SEQ ID NO: 5827 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatttgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctacttcgctcattttgaattaaggtcctttacgtcatgcaaatttggggaacatcaaagagacaaagactagggaccactattcttacagttcccctcatggtctgagaatatagctggga

SEQ ID NO: 5828 - DNA, 472 bp, Artificial; identical to SEQ ID NO: 5101
  TaSBEIIa  allele with mutations introduced by TALEN pair TaSBEIIa_T01

SEQ ID NO: 5829 - DNA, 469 bp, Artificial; identical to SEQ ID NO: 5084
  TaSBEIIa  allele with mutations introduced by TALEN pair TaSBEIIa_T01

SEQ ID NO: 5830 - DNA, 469 bp, Artificial; identical to SEQ ID NO: 5084
  TaSBEIIa  allele with mutations introduced by TALEN pair TaSBEIIa_T01

SEQ ID NO: 5831 - DNA, 467 bp, Artificial; identical to SEQ ID NO: 5092
  TaSBEIIa  allele with mutations introduced by TALEN pair TaSBEIIa_T01

SEQ ID NO: 5832 - DNA, 467 bp, Artificial; identical to SEQ ID NO: 5669
  TaSBEIIa  allele with mutations introduced by TALEN pair TaSBEIIa_T01

SEQ ID NO: 5833 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttggggaacatcaaagagacaaagactagggaccactatttcttacagttcccctcactggtctgagaatatgctggga

SEQ ID NO: 5834 - DNA, 471 bp, Artificial; identical to SEQ ID NO: 5216
  TaSBEIIa  allele with mutations introduced by TALEN pair TaSBEIIa_T01

SEQ ID NO: 5835 - DNA, 466 bp, Artificial; identical to SEQ ID NO: 5261
  TaSBEIIa  allele with mutations introduced by TALEN pair TaSBEIIa_T01

SEQ ID NO: 5836 - DNA, 472 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctattttcggagccatcttgactaccggtaatgcctacccgctaatttcgctcattttgaattaaggtcctttcatcatgcaaatttggggaacatcaaagaggacaaagactagggaccactatttcatacagttcccctcatggtctgagaatatgctggga

SEQ ID NO: 5837 - DNA, 467 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaaccagtcgcgggggagaaaccgcgagttgtcccaaaaccaggagatgggcagaaaatatacgagattgacccaaattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 5838 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctacttcgctcattttgaattaaggtcctttcgtcatgcaaatttggggaacatcaaagagacaaagactagggaccactatttcttacagttcccctcatggtctgagaatatagctggga

SEQ ID NO: 5839 - DNA, 469 bp, Artificial; identical to SEQ ID NO: 5084
  TaSBEIIa  allele with mutations introduced by TALEN pair TaSBEIIa_T01

SEQ ID NO: 5840 - DNA, 468 bp, Artificial; identical to SEQ ID NO: 5089
  TaSBEIIa  allele with mutations introduced by TALEN pair TaSBEIIa_T01

SEQ ID NO: 5841 - DNA, 468 bp, Artificial
  TaSBEIIa  allele with mutations introduced by TALEN pair TaSBEIIa_T01
  misc_feature (446): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctatttcggagccatcttgactaccggtaatgcctacccgctactttcgctcattttgaattaaggtccttttcgtcatgcaaatttggggaacatcaaagagacaaagactagggaccactatttcttacagttcccctnatggtctgagaatatgctggga

SEQ ID NO: 5842 - DNA, 454 bp, Artificial
  TaSBEIIa  allele with mutations introduced by TALEN pair TaSBEIIa_T01
tcagtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctaccgctgctttcgctcatttgaattaaggtcctttcatcatgcaaatttgggacatcaaagagacaaagactaggaccaccattcatacagatcccctcgtggtctgagaatatgctggga

SEQ ID NO: 5843 - DNA, 467 bp, Artificial; identical to SEQ ID NO: 5092
  TaSBEIIa  allele with mutations introduced by TALEN pair TaSBEIIa_T01

SEQ ID NO: 5844 - DNA, 468 bp, Artificial; identical to SEQ ID NO: 5089
  TaSBEIIa  allele with mutations introduced by TALEN pair TaSBEIIa_T01

SEQ ID NO: 5845 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtccttcgtcatgcaaatttggggaacatcaaagagacaaagactagggaccactattcttacacgttcccctcatggtctgagaatatgctggga

SEQ ID NO: 5846 - DNA, 468 bp, Artificial; identical to SEQ ID NO: 5091
  TaSBEIIa  allele with mutations introduced by TALEN pair TaSBEIIa_T01

SEQ ID NO: 5847 - DNA, 467 bp, Artificial; identical to SEQ ID NO: 5095
  TaSBEIIa  allele with mutations introduced by TALEN pair TaSBEIIa_T01

SEQ ID NO: 5848 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctacccgctactttcgctcatttgaattaaggtccttcgtcatgcaaatttggggaacatcaaagagacaaagactagggaccactatttcttacagttcccctcatggtctgagaatatgctggga

SEQ ID NO: 5849 - DNA, 468 bp, Artificial; identical to SEQ ID NO: 5234
  TaSBEIIa  allele with mutations introduced by TALEN pair TaSBEIIa_T01

SEQ ID NO: 5850 - DNA, 466 bp, Artificial; identical to SEQ ID NO: 5724
  TaSBEIIa  allele with mutations introduced by TALEN pair TaSBEIIa_T01

SEQ ID NO: 5851 - DNA, 443 bp, Artificial; identical to SEQ ID NO: 5106
  TaSBEIIa  allele with mutations introduced by TALEN pair TaSBEIIa_T01

SEQ ID NO: 5852 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacagattttcggagccatcttgactaccggtaatgcctacccgctgctttcgctcattttgaattaaggtcctttcatcatgcaaatttggggaacatcaaagagacaaagactagggaccaccattcatacagatccctcgtgtctgagaatgtgctggga

SEQ ID NO: 5853 - DNA, 467 bp, Artificial; identical to SEQ ID NO: 5471
  TaSBEIIa  allele with mutations introduced by TALEN pair TaSBEIIa_T01

SEQ ID NO: 5854 - DNA, 471 bp, Artificial
  TaSBEIIa  allele with mutations introduced by TALEN pair TaSBEIIa_T01
  misc_feature (459): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctacttttcgctcatttttgaattaaggtcctttcgtcatgcaaatttggggaacatcaaagagacaaagactagggaccactatttcttacagttccctcatggtctggaanaatatgcgtgga

SEQ ID NO: 5855 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgtttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5856 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccattttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 5857 - DNA, 463 bp, Artificial
  TaSBEIIa  allele with mutations introduced by TALEN pair TaSBEIIa_T01
tcagatgatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcatttgaattaaggtcctttcgtcatgcaaatttggggaacatcaaagagacaaagactagggaccactattcttacagttcccctcatggtctgagaatatgctggga

SEQ ID NO: 5858 - DNA, 468 bp, Artificial
  TaSBEIIa  allele with mutations introduced by TALEN pair TaSBEIIa_T01
  misc_feature (453): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccatttcatacagactcccctcgtggtcngagaatatgctggga

SEQ ID NO: 5859 - DNA, 468 bp, Artificial; identical to SEQ ID NO: 5359
  TaSBEIIa  allele with mutations introduced by TALEN pair TaSBEIIa_T01

SEQ ID NO: 5860 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgtttcggagccatcttgactaccggtaatgcctaccgctgctttcgctcattttgaattaaggtcctttcatcatgcaaatttggggaacatacaaagagacaaagactagggaccaccatttcatacagatcccctcgtggtctgagaatatgctggga

SEQ ID NO: 5861 - DNA, 469 bp, Artificial; identical to SEQ ID NO: 5639
  TaSBEIIa  allele with mutations introduced by TALEN pair TaSBEIIa_T01

SEQ ID NO: 5862 - DNA, 467 bp, Artificial; identical to SEQ ID NO: 5092
  TaSBEIIa  allele with mutations introduced by TALEN pair TaSBEIIa_T01

SEQ ID NO: 5863 - DNA, 471 bp, Artificial
  TaSBEIIa  allele with mutations introduced by TALEN pair TaSBEIIa_T01
tcagatggatgtgcattctagcaagaacttcacaacataatgcaccgtttgggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5864 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatcgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 5865 - DNA, 470 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgttttcggagccatcttgactaccggtaatgcctacccgctaatttcgctcattttgaattaaggtcctttcatcatgcaaatttggggaacatcaaagaggcaaagactagggaccactattcatacagttcccctcatggtctgagaatatgctggga

SEQ ID NO: 5866 - DNA, 469 bp, Artificial; identical to SEQ ID NO: 5242
  TaSBEIIa  allele with mutations introduced by TALEN pair TaSBEIIa_T01

SEQ ID NO: 5867 - DNA, 468 bp, Artificial; identical to SEQ ID NO: 5855
  TaSBEIIa  allele with mutations introduced by TALEN pair TaSBEIIa_T01

SEQ ID NO: 5868 - DNA, 471 bp, Artificial
  TaSBEIIa  allele with mutations introduced by TALEN pair TaSBEIIa_T01
  misc_feature (449): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgattttcggagccatcttgactaccggtaatgcctacccgctaatttcgctcattttgaattaaggtcctttcatcatgcaaatttggggaacatcaaagaggcaaagactagggaccactatttcatacagttccccnatggtctgagaatatgctggga

SEQ ID NO: 5869 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatagctggga

SEQ ID NO: 5870 - DNA, 470 bp, Artificial; identical to SEQ ID NO: 5112
  TaSBEIIa  allele with mutations introduced by TALEN pair TaSBEIIa_T01

SEQ ID NO: 5871 - DNA, 466 bp, Artificial
  TaSBEIIa  allele with mutations introduced by TALEN pair TaSBEIIa_T01
  misc_feature (245): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggganaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5872 - DNA, 461 bp, Artificial; identical to SEQ ID NO: 5198
  TaSBEIIa  allele with mutations introduced by TALEN pair TaSBEIIa_T01

SEQ ID NO: 5873 - DNA, 466 bp, Artificial; identical to SEQ ID NO: 5145
  TaSBEIIa  allele with mutations introduced by TALEN pair TaSBEIIa_T01

SEQ ID NO: 5874 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgtttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5875 - DNA, 468 bp, Artificial; identical to SEQ ID NO: 5083
  TaSBEIIa  allele with mutations introduced by TALEN pair TaSBEIIa_T01

SEQ ID NO: 5876 - DNA, 472 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaaccaaaggagttaaggaactagtcgtgggggagaaaccgcgagttgtcccaaaaccaggagatgggcagaaaatatacgagattgaacccaacacagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5877 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 5878 - DNA, 467 bp, Artificial; identical to SEQ ID NO: 5092
  TaSBEIIa  allele with mutations introduced by TALEN pair TaSBEIIa_T01

SEQ ID NO: 5879 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtccttcgtcatgcaaatttggggaacatcaaagagacaaagactagggaccactatttctacagttcccctcatggtctgagaatatgctggga

SEQ ID NO: 5880 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctgga

SEQ ID NO: 5881 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagaacaaagactagggaccactatttcttacagttcccctcatggtctgagtaatatgctggga

SEQ ID NO: 5882 - DNA, 471 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattacatacagatcccctcgtggtctgagaatatgctggga

SEQ ID NO: 5883 - DNA, 470 bp, Artificial; identical to SEQ ID NO: 5112
  TaSBEIIa  allele with mutations introduced by TALEN pair TaSBEIIa_T01

SEQ ID NO: 5884 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctctattttgaattaaggtcctttcatcatgcaaatttggggaacatcaaagagacaaagactagggaccaccatttcatacagatcccctcgtggtctgagaatatgctggga

SEQ ID NO: 5885 - DNA, 470 bp, Artificial; identical to SEQ ID NO: 5112
  TaSBEIIa  allele with mutations introduced by TALEN pair TaSBEIIa_T01

SEQ ID NO: 5886 - DNA, 468 bp, Artificial; identical to SEQ ID NO: 5089
  TaSBEIIa  allele with mutations introduced by TALEN pair TaSBEIIa_T01

SEQ ID NO: 5887 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgttagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctcatggtctgtagaatatgctggga

SEQ ID NO: 5888 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatacaaagagacaaagactagggaccactatttcttacagttcccctcatggtctgagaatatgctgga

SEQ ID NO: 5889 - DNA, 467 bp, Artificial; identical to SEQ ID NO: 5092
  TaSBEIIa  allele with mutations introduced by TALEN pair TaSBEIIa_T01

SEQ ID NO: 5890 - DNA, 468 bp, Artificial; identical to SEQ ID NO: 5089
  TaSBEIIa  allele with mutations introduced by TALEN pair TaSBEIIa_T01

SEQ ID NO: 5891 - DNA, 470 bp, Artificial; identical to SEQ ID NO: 5112
  TaSBEIIa  allele with mutations introduced by TALEN pair TaSBEIIa_T01

SEQ ID NO: 5892 - DNA, 470 bp, Artificial; identical to SEQ ID NO: 5112
  TaSBEIIa  allele with mutations introduced by TALEN pair TaSBEIIa_T01

SEQ ID NO: 5893 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacactattttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagatatgctgga

SEQ ID NO: 5894 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttggggaacatcaaagagacaaagactagggaccactatttcttacacgttcccctcatggtctgagaatatgctggga

SEQ ID NO: 5895 - DNA, 471 bp, Artificial; identical to SEQ ID NO: 5216
  TaSBEIIa  allele with mutations introduced by TALEN pair TaSBEIIa_T01

SEQ ID NO: 5896 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaagactagggaccaccatttcatacagatcccctcgtggtctgagaatatgctggga

SEQ ID NO: 5897 - DNA, 472 bp, Artificial; identical to SEQ ID NO: 5101
  TaSBEIIa  allele with mutations introduced by TALEN pair TaSBEIIa_T01

SEQ ID NO: 5898 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 5899 - DNA, 468 bp, Artificial; identical to SEQ ID NO: 5234
  TaSBEIIa  allele with mutations introduced by TALEN pair TaSBEIIa_T01

SEQ ID NO: 5900 - DNA, 470 bp, Artificial; identical to SEQ ID NO: 5112
  TaSBEIIa  allele with mutations introduced by TALEN pair TaSBEIIa_T01

SEQ ID NO: 5901 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgaccaacactattttcggagccatcttgactaccggtaatgcctacccgctgctttcgctcattttgaattaaggtcctttcatcatgcaaatttggggaacatcaaaagagacaaagactagggaccaccatttcatacagatcccctcgtggtctgagaatatgctggga

SEQ ID NO: 5902 - DNA, 468 bp, Artificial; identical to SEQ ID NO: 5089
  TaSBEIIa  allele with mutations introduced by TALEN pair TaSBEIIa_T01

SEQ ID NO: 5903 - DNA, 468 bp, Artificial; identical to SEQ ID NO: 5091
  TaSBEIIa  allele with mutations introduced by TALEN pair TaSBEIIa_T01

SEQ ID NO: 5904 - DNA, 468 bp, Artificial; identical to SEQ ID NO: 5089
  TaSBEIIa  allele with mutations introduced by TALEN pair TaSBEIIa_T01

SEQ ID NO: 5905 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatcgcctaccgctactttcgctcatttgaattaaggtcctttcgtcatgcaaatttggggaacatcaaagagacaaagactagggaccactatttcttacagttcccctcatggtctgagaatatgctggga

SEQ ID NO: 5906 - DNA, 469 bp, Artificial; identical to SEQ ID NO: 5084
  TaSBEIIa  allele with mutations introduced by TALEN pair TaSBEIIa_T01

SEQ ID NO: 5907 - DNA, 470 bp, Artificial; identical to SEQ ID NO: 5112
  TaSBEIIa  allele with mutations introduced by TALEN pair TaSBEIIa_T01

SEQ ID NO: 5908 - DNA, 467 bp, Artificial; identical to SEQ ID NO: 5593
  TaSBEIIa  allele with mutations introduced by TALEN pair TaSBEIIa_T01

SEQ ID NO: 5909 - DNA, 467 bp, Artificial; identical to SEQ ID NO: 5475
  TaSBEIIa  allele with mutations introduced by TALEN pair TaSBEIIa_T01

SEQ ID NO: 5910 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgtttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctgga

SEQ ID NO: 5911 - DNA, 467 bp, Artificial; identical to SEQ ID NO: 5092
  TaSBEIIa  allele with mutations introduced by TALEN pair TaSBEIIa_T01

SEQ ID NO: 5912 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgcgga

SEQ ID NO: 5913 - DNA, 466 bp, Artificial; identical to SEQ ID NO: 5277
  TaSBEIIa  allele with mutations introduced by TALEN pair TaSBEIIa_T01

SEQ ID NO: 5914 - DNA, 468 bp, Artificial; identical to SEQ ID NO: 5602
  TaSBEIIa  allele with mutations introduced by TALEN pair TaSBEIIa_T01

SEQ ID NO: 5915 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctaccgctactttcgctcatttgaattaaggtcctttcgtcatgcaaatttggggaacatcaaagagacaaagactagggaccactattcttacagttccctcatggtctgagaatatgctggga

SEQ ID NO: 5916 - DNA, 469 bp, Artificial; identical to SEQ ID NO: 5084
  TaSBEIIa  allele with mutations introduced by TALEN pair TaSBEIIa_T01

SEQ ID NO: 5917 - DNA, 468 bp, Artificial; identical to SEQ ID NO: 5147
  TaSBEIIa  allele with mutations introduced by TALEN pair TaSBEIIa_T01

SEQ ID NO: 5918 - DNA, 464 bp, Artificial; identical to SEQ ID NO: 5105
  TaSBEIIa  allele with mutations introduced by TALEN pair TaSBEIIa_T01

SEQ ID NO: 5919 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatcgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5920 - DNA, 466 bp, Artificial; identical to SEQ ID NO: 5277
  TaSBEIIa  allele with mutations introduced by TALEN pair TaSBEIIa_T01

SEQ ID NO: 5921 - DNA, 471 bp, Artificial; identical to SEQ ID NO: 5216
  TaSBEIIa  allele with mutations introduced by TALEN pair TaSBEIIa_T01

SEQ ID NO: 5922 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttgtcatgcaaatttgggaacatcaaagagacaaagactagggaccactattacttacagttccctcatggtctgagaatatgactggga

SEQ ID NO: 5923 - DNA, 469 bp, Artificial; identical to SEQ ID NO: 5084
  TaSBEIIa  allele with mutations introduced by TALEN pair TaSBEIIa_T01

SEQ ID NO: 5924 - DNA, 467 bp, Artificial; identical to SEQ ID NO: 5297
  TaSBEIIa  allele with mutations introduced by TALEN pair TaSBEIIa_T01

SEQ ID NO: 5925 - DNA, 472 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgaattttcggagccatcttgactaccggtaatgcctacccgctgctttcgctcattttgaattaaggtcctttcatcatgcaaatttggggaacatcaaagagacaaagactagggaccaccatttcatacagatcccctcgtcggtctgagaatatgctggga

SEQ ID NO: 5926 - DNA, 463 bp, Artificial
  TaSBEIIa  allele with mutations introduced by TALEN pair TaSBEIIa_T01
  misc_feature (287): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatntacgagattgacccaacttttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 5927 - DNA, 466 bp, Artificial; identical to SEQ ID NO: 5145
  TaSBEIIa  allele with mutations introduced by TALEN pair TaSBEIIa_T01

SEQ ID NO: 5928 - DNA, 471 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccgatttcatacagatcccctcgtggtctgagaatatgctggga

SEQ ID NO: 5929 - DNA, 468 bp, Artificial; identical to SEQ ID NO: 5089
  TaSBEIIa  allele with mutations introduced by TALEN pair TaSBEIIa_T01

SEQ ID NO: 5930 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgaagatactgctggga

SEQ ID NO: 5931 - DNA, 467 bp, Artificial; identical to SEQ ID NO: 5168
  TaSBEIIa  allele with mutations introduced by TALEN pair TaSBEIIa_T01

SEQ ID NO: 5932 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttgggaacatcaaagagacaaagactagggaccactattctacagttcccctcatggtctgagaatatgctggga

SEQ ID NO: 5933 - DNA, 468 bp, Artificial; identical to SEQ ID NO: 5089
  TaSBEIIa  allele with mutations introduced by TALEN pair TaSBEIIa_T01

SEQ ID NO: 5934 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacattttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5935 - DNA, 465 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaatatacgagattgacccaaattttcggagccatcttgactaccggtaatgcctacccgctaatttcgctcattttgaattaaggtcctttcatcatgcaaatttggggaacatcaaagaggcaaagactagggaccactattcatacagttcccctcatggtctgagaatatgctggga

SEQ ID NO: 5936 - DNA, 468 bp, Artificial; identical to SEQ ID NO: 5463
  TaSBEIIa  allele with mutations introduced by TALEN pair TaSBEIIa_T01

SEQ ID NO: 5937 - DNA, 472 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtacccaaaaccaggagatgggcagaaaatatacgagattgacccaacactgtttcggagccatcttgactaccggtaatgcctacccgctgctttcgcttcattttgaatttaaggtcctttcatcatgcaaatttggggaacatcaaagagacaaagactagggaccaccatttcatacagatcccctcgtggtctgagaatatgctggga

SEQ ID NO: 5938 - DNA, 468 bp, Artificial; identical to SEQ ID NO: 5359
  TaSBEIIa  allele with mutations introduced by TALEN pair TaSBEIIa_T01

SEQ ID NO: 5939 - DNA, 469 bp, Artificial
  TaSBEIIa  allele with mutations introduced by TALEN pair TaSBEIIa_T01
tcagatggatgtgcattctagcaagaacttcacaacataaatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5940 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttggggaacatcaaagagacaaagactagggaccactatttcttacagttccccctcatggtctgagaatatgctggga

SEQ ID NO: 5941 - DNA, 466 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacattttcggagccatcttgactaccggtaatgcctaccgctgctttcgctcattttgaattaaggtcctttcatcatgcaaatttggggaacatcaaagagacaaagactagggaccaccatttcatacagatcccctgtggtccgagaatatgctggga

SEQ ID NO: 5942 - DNA, 472 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgaattttcggagccatcttgactaccggtaatgcctacccgctgctttcgctcatttttgaattaaggtcctttcatcatgcaaatttggggaacatcaaagagacaaagactagggaccaccatttcatacagatcccctcgtggtctgagaatatgctggga

SEQ ID NO: 5943 - DNA, 464 bp, Artificial; identical to SEQ ID NO: 5450
  TaSBEIIa  allele with mutations introduced by TALEN pair TaSBEIIa_T01

SEQ ID NO: 5944 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5945 - DNA, 469 bp, Artificial; identical to SEQ ID NO: 5084
  TaSBEIIa  allele with mutations introduced by TALEN pair TaSBEIIa_T01

SEQ ID NO: 5946 - DNA, 461 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacttttcggagccatcttgactaccggtaatgcctacccgctactttcgctcattttgaattaaggtcctttcgtcatgcaaatttggggaacatcaaagagacaaagactagggaccactattctacagttccctcatggtctgagaatatgctggga

SEQ ID NO: 5947 - DNA, 467 bp, Artificial; identical to SEQ ID NO: 5475
  TaSBEIIa  allele with mutations introduced by TALEN pair TaSBEIIa_T01

SEQ ID NO: 5948 - DNA, 470 bp, Artificial; identical to SEQ ID NO: 5112
  TaSBEIIa  allele with mutations introduced by TALEN pair TaSBEIIa_T01

SEQ ID NO: 5949 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcattttgaattaaggtcctttcatcatgcaaatttggggaacatcaaagagacaaagactatggaccaccatttcatacagatcccctcgtggtctgagaatatgctggga

SEQ ID NO: 5950 - DNA, 470 bp, Artificial; identical to SEQ ID NO: 5112
  TaSBEIIa  allele with mutations introduced by TALEN pair TaSBEIIa_T01

SEQ ID NO: 5951 - DNA, 465 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaagattttcggagccatcttgactaccggtaatgcctacccgctgctttcgctcattttgaattaaggtcctttcatcatgcaaatttggggaacatcaaagagacaaagactagggaccacatttcatacagatcccctcgtggtctgagaatatgctggga

SEQ ID NO: 5952 - DNA, 468 bp, Artificial; identical to SEQ ID NO: 5219
  TaSBEIIa  allele with mutations introduced by TALEN pair TaSBEIIa_T01

SEQ ID NO: 5953 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5954 - DNA, 467 bp, Artificial; identical to SEQ ID NO: 5475
  TaSBEIIa  allele with mutations introduced by TALEN pair TaSBEIIa_T01

SEQ ID NO: 5955 - DNA, 467 bp, Artificial; identical to SEQ ID NO: 5092
  TaSBEIIa  allele with mutations introduced by TALEN pair TaSBEIIa_T01

SEQ ID NO: 5956 - DNA, 467 bp, Artificial; identical to SEQ ID NO: 5526
  TaSBEIIa  allele with mutations introduced by TALEN pair TaSBEIIa_T01

SEQ ID NO: 5957 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtccttcgtcatgcaaatttgggaacatcaaagagacaaagactagggaccactatttcttacagttcccctcatggtctgagaatatgctggga

SEQ ID NO: 5958 - DNA, 471 bp, Artificial; identical to SEQ ID NO: 5216
  TaSBEIIa  allele with mutations introduced by TALEN pair TaSBEIIa_T01

SEQ ID NO: 5959 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatagcctacccgctactttcgctcattttgaattaaggtcctttcgtcatgcaaatttggggaacatcaaagagacaaagactagggaccactatttcttacagttcccctcatggtctgagaatatgctgggta

SEQ ID NO: 5960 - DNA, 467 bp, Artificial
  TaSBEIIa  allele with mutations introduced by TALEN pair TaSBEIIa_T01
  misc_feature (445): n is a or c or t or g
tcagatggatgtgcattctagcaagaacttcacgaaataatgcactgtttgtggtttcgttagtctgctctacaattgctattttcgtgctgtagatacctgaaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctatttcggagccatcttgactaccggtaatgcctacccgctactttcgctcattttgaattaaggtcctttcgtcatgcaaatttgggaacatcaaagagacaaagactagggaccactatttcttacagttcccctnatggtctgagaatatgcgtgga

SEQ ID NO: 5961 - DNA, 459 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgccatcttgactaccggtaatgcctacccgctaatttcgctcattttgaattaaggccttttcatcatgcaaatttgggaacatcaaagaggcaaagactagggaccactattcatacagttcccctcatggtctgagaatatgctggga

SEQ ID NO: 5962 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagactccctcgtggtctgagaatatgctggga

SEQ ID NO: 5963 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctaccgctactttcgctcattttgaattaaggtcctttcgtcatgcaaatttggggaacatcaaagagacaaagactagggaccactatttcttaacagttcccctcatggtctgagaatatgctggga

SEQ ID NO: 5964 - DNA, 466 bp, Artificial; identical to SEQ ID NO: 5145
  TaSBEIIa  allele with mutations introduced by TALEN pair TaSBEIIa_T01

SEQ ID NO: 5965 - DNA, 468 bp, Artificial; identical to SEQ ID NO: 5310
  TaSBEIIa  allele with mutations introduced by TALEN pair TaSBEIIa_T01

SEQ ID NO: 5966 - DNA, 466 bp, Artificial; identical to SEQ ID NO: 5760
  TaSBEIIa  allele with mutations introduced by TALEN pair TaSBEIIa_T01

SEQ ID NO: 5967 - DNA, 466 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatagctggga

SEQ ID NO: 5968 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcatttgaattaaggtcctttcatcatgcaaatttggggaacatcaaagagacaaagactagggaccaccatttcatacagactcccctgtggtctgagaatatgctggga

SEQ ID NO: 5969 - DNA, 467 bp, Artificial; identical to SEQ ID NO: 5092
  TaSBEIIa  allele with mutations introduced by TALEN pair TaSBEIIa_T01

SEQ ID NO: 5970 - DNA, 468 bp, Artificial
  TaSBEIIa  allele with mutations introduced by TALEN pair TaSBEIIa_T01
tcagatggatgtgcattctagcaagaacttcaacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtccttttacgcatgcaaatttggggaacatcaaagagacaaagactagggaccactatttcttacagttcccctcatggtctgagaatatgctggga

SEQ ID NO: 5971 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 5972 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcatttgaattaaggtcctttcatcatgcaaatttggggaacatcaaagagacaaagactagggaccaccatttcatacagatcccctcgtggtctgagaatatgctgggga

SEQ ID NO: 5973 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttgggaacatcaaagagacaaagactagggaccactatttcttacacgttcccctcatggtctgagaatatgctggga

SEQ ID NO: 5974 - DNA, 472 bp, Artificial; identical to SEQ ID NO: 5101
  TaSBEIIa  allele with mutations introduced by TALEN pair TaSBEIIa_T01

SEQ ID NO: 5975 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 5976 - DNA, 467 bp, Artificial; identical to SEQ ID NO: 5593
  TaSBEIIa  allele with mutations introduced by TALEN pair TaSBEIIa_T01

SEQ ID NO: 5977 - DNA, 467 bp, Artificial
  TaSBEIIa  allele with mutations introduced by TALEN pair TaSBEIIa_T01
tcagatgatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 5978 - DNA, 508 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtccaaaaccaggagatgggcagaaaatatacgagattgacccaacaggcgctggagacggtccagcggctgttgccggtgctgtgccaggcccacggcttgaccccccagcaggtggtggccattgctggccatcttgactaccggtaatgcctacccgctgctttcgctcattttgaattaaggtcctttcatcatgcaaatttggggaacatcaaagagacaaagactaggaccaccatttcattaa

SEQ ID NO: 5979 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctgggaa

SEQ ID NO: 5980 - DNA, 469 bp, Artificial; identical to SEQ ID NO: 5084
  TaSBEIIa  allele with mutations introduced by TALEN pair TaSBEIIa_T01

SEQ ID NO: 5981 - DNA, 470 bp, Artificial
  TaSBEIIa  allele with mutations introduced by TALEN pair TaSBEIIa_T01
  misc_feature (448): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtccttttcgtcatgcaaatttggggaacatcaaaagagacaaagactagggaccactatttcttacagttcccctnatggtctgagaatatgctggga

SEQ ID NO: 5982 - DNA, 471 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatagctggga

SEQ ID NO: 5983 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttgggaacatcaaagagacaaagactagggaccactattcttacagttcccctcatggtctgagatatgctggga

SEQ ID NO: 5984 - DNA, 469 bp, Artificial; identical to SEQ ID NO: 5194
  TaSBEIIa  allele with mutations introduced by TALEN pair TaSBEIIa_T01

SEQ ID NO: 5985 - DNA, 468 bp, Artificial; identical to SEQ ID NO: 5234
  TaSBEIIa  allele with mutations introduced by TALEN pair TaSBEIIa_T01

SEQ ID NO: 5986 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcatttgaattaaggtcctttcatcatgcaaatttggggaacatcaaagagacaaagactaagggaccaccaatttcatacagatcccctcgtggtctgagaatatgctggga

SEQ ID NO: 5987 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacgctattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5988 - DNA, 467 bp, Artificial
  TaSBEIIa  allele with mutations introduced by TALEN pair TaSBEIIa_T01
tcagatgatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 5989 - DNA, 463 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 5990 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaagctgaattttcggagccatcttgactaccggtaatgcctacccgctactttcgctcattttgaattaaggtcctttcgtcatgcaaatttgggaacatcaaagagacaaagactagggaccactatttctacagttcccctcatggtctgagaatatgctggga

SEQ ID NO: 5991 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcactggtctgagaatatgctggga

SEQ ID NO: 5992 - DNA, 472 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgaattttcggagccatcttgactaccggtaatcgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 5993 - DNA, 469 bp, Artificial; identical to SEQ ID NO: 5084
  TaSBEIIa  allele with mutations introduced by TALEN pair TaSBEIIa_T01

SEQ ID NO: 5994 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttggggaacatcaaagagacaaagactagggaccactatttcttacagttccccctcatggtctgagaatatgctggga

SEQ ID NO: 5995 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaagtttggggaacatcaaagagacaaagactagggaccaccatttcatacagactcccctcgtggtctgagaatatgctggga

SEQ ID NO: 5996 - DNA, 472 bp, Artificial; identical to SEQ ID NO: 5101
  TaSBEIIa  allele with mutations introduced by TALEN pair TaSBEIIa_T01

SEQ ID NO: 5997 - DNA, 471 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccattttgactaccggtaatgcctacccgctactttcgctcattttgaattaaggtccttttcgtcatgcaaatttggggaacatcaaagagacaaagactagggaccactattcttacagttcccctcataggtctgagatatgctggga

SEQ ID NO: 5998 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccacgtatttcttacacgttcccctcatggtctgagaatatgctggga

SEQ ID NO: 5999 - DNA, 471 bp, Artificial
  TaSBEIIa  allele with mutations introduced by TALEN pair TaSBEIIa_T01
tcagatggatgtgcattctagcaagaacttcacaacataatggcaccgtttgggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactatttcggagccatcttgactaccggtaatgcctacccgctgctttcgctcattttgaattaacggtcctttcattcatgcaaatttggggaacatcaaagagacaaagactagggaccaccatttcatacagatcccctgtggtctgagaatatgctggga

SEQ ID NO: 6000 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtcccaaaaccaggagatgggcagaaaatatacgagattgacccaacgctgattttcggagccatcttgactaccggtaatgcctaccgctactttcgctcatttgaattaaggtcctttcgtcatgcaaatttggggaacatcaaagagacaaagactagggaccactatttcttacagttcccctcatggtctgagaatatgctggga

SEQ ID NO: 6001 - DNA, 463 bp, Artificial; identical to SEQ ID NO: 5317
  TaSBEIIa  allele with mutations introduced by TALEN pair TaSBEIIa_T01

SEQ ID NO: 6002 - DNA, 461 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcatttgaattaaggtcctttcgtcatgcaaatttgggaacatcaaagagacaaagactagggacactattcttacagttccctcatggtctgagaatatgctggga

SEQ ID NO: 6003 - DNA, 464 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtcccaaaaccaggagatgggcagaaaatatacgagattgacccaacgctttttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 6004 - DNA, 469 bp, Artificial; identical to SEQ ID NO: 5894
  TaSBEIIa  allele with mutations introduced by TALEN pair TaSBEIIa_T01

SEQ ID NO: 6005 - DNA, 470 bp, Artificial; identical to SEQ ID NO: 5167
  TaSBEIIa  allele with mutations introduced by TALEN pair TaSBEIIa_T01

SEQ ID NO: 6006 - DNA, 468 bp, Artificial
  TaSBEIIa  allele with mutations introduced by TALEN pair TaSBEIIa_T01
tcagatggatgtgcattctagcaagaacttcacgaaataatgcgactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctacttttcgctcattttgaattaaggtccttcgtcatgcaaatttggggaacatcaaagagacaaagactagggaccactattcttacagttcccctcatggtctgagaatatgctggga

SEQ ID NO: 6007 - DNA, 473 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaaattaaggtcctttcgtcatgcaaatttggggaacatcaaagagacaaagactagggaccactatttcttacagttccccttccatggtcttgagaatatagctggga

SEQ ID NO: 6008 - DNA, 468 bp, Artificial; identical to SEQ ID NO: 5547
  TaSBEIIa  allele with mutations introduced by TALEN pair TaSBEIIa_T01

SEQ ID NO: 6009 - DNA, 468 bp, Artificial; identical to SEQ ID NO: 5231
  TaSBEIIa  allele with mutations introduced by TALEN pair TaSBEIIa_T01

SEQ ID NO: 6010 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctacttcgctcattttgaattaggtcctttcgtcatgcaaatttggggaacatcaaagagacaaagactagggaccactattcttacagttcccctcatggtctgagaatatgctggga

SEQ ID NO: 6011 - DNA, 465 bp, Artificial; identical to SEQ ID NO: 5289
  TaSBEIIa  allele with mutations introduced by TALEN pair TaSBEIIa_T01

SEQ ID NO: 6012 - DNA, 520 bp, Artificial
  TaSBEIIa  allele with mutations introduced by TALEN pair TaSBEIIa_T01
  misc_feature (451): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgtttttgctcacccagaaacgctggtgaaagtaaaagatgctgaagatcagttgggtgcacgagtgggttattttcggagccatcttgactaccggtaatgcctaccgctaatttcgctcattttgaattaaggtcctttnatcatgcaaatttggggaacatacaaagaggtcaaagactagggaccatatttcatacagttcccctct

SEQ ID NO: 6013 - DNA, 469 bp, Artificial
  TaSBEIIa  allele with mutations introduced by TALEN pair TaSBEIIa_T01
tcagatggatgtgcattctagcaagaacttcacgaaataatgcgactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6014 - DNA, 463 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacactcggagccatcttgactaccggtaatgcctacccgctgctttcgctcattttgaattaaggtcctttcatcatgcaaatttggggaacatcaaagagacaaagactagggaccaccattcatacagatcccctcgtggtctgagaatatgctggga

SEQ ID NO: 6015 - DNA, 468 bp, Artificial
  TaSBEIIa  allele with mutations introduced by TALEN pair TaSBEIIa_T01
  misc_feature (454): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttgggtaacatcaaagagacaaagactagggaccactattcttactagttccctcactggtctganaagggtatgctgga

SEQ ID NO: 6016 - DNA, 468 bp, Artificial; identical to SEQ ID NO: 5091
  TaSBEIIa  allele with mutations introduced by TALEN pair TaSBEIIa_T01

SEQ ID NO: 6017 - DNA, 471 bp, Artificial; identical to SEQ ID NO: 5216
  TaSBEIIa  allele with mutations introduced by TALEN pair TaSBEIIa_T01

SEQ ID NO: 6018 - DNA, 468 bp, Artificial; identical to SEQ ID NO: 5089
  TaSBEIIa  allele with mutations introduced by TALEN pair TaSBEIIa_T01

SEQ ID NO: 6019 - DNA, 468 bp, Artificial; identical to SEQ ID NO: 5146
  TaSBEIIa  allele with mutations introduced by TALEN pair TaSBEIIa_T01

SEQ ID NO: 6020 - DNA, 469 bp, Artificial
  TaSBEIIa  allele with mutations introduced by TALEN pair TaSBEIIa_T01
tcagatggatgtgcattctagcaagaacttcacgaaataatgcgactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 6021 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgccctaccgctactttcgctcattttgaattaaggtccttttcgtcatgcaaatttggggaacatcaaagagacaaagactagggaccactatttcttacagttccccttatggtctgagaatatgctggga

SEQ ID NO: 6022 - DNA, 467 bp, Artificial; identical to SEQ ID NO: 5092
  TaSBEIIa  allele with mutations introduced by TALEN pair TaSBEIIa_T01

SEQ ID NO: 6023 - DNA, 468 bp, Artificial; identical to SEQ ID NO: 5083
  TaSBEIIa  allele with mutations introduced by TALEN pair TaSBEIIa_T01

SEQ ID NO: 6024 - DNA, 470 bp, Artificial; identical to SEQ ID NO: 5112
  TaSBEIIa  allele with mutations introduced by TALEN pair TaSBEIIa_T01

SEQ ID NO: 6025 - DNA, 471 bp, Artificial; identical to SEQ ID NO: 5258
  TaSBEIIa  allele with mutations introduced by TALEN pair TaSBEIIa_T01

SEQ ID NO: 6026 - DNA, 471 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaaacggcggaagtgaacatgacaggggggactgcagagaaacttcaatcttcagaaccgactcagggcattgtggaaacaatcaactgatggtgtaaccaaaggagttaaggaactagtcgtgggggagaaaccgcgagttgtcccaaaaccaggagatgggcagaaaatatacgagattgacccaacactattttcggagccatcttgactaccggtaatgcctacccgctgctttcgctcattttgaattaaggtcctttcatcatgcaaatttggggaacatcaaagagacaaagactagggaccacatttcatacagatcccctcgtcggtctgagaatatgctggga

SEQ ID NO: 6027 - DNA, 468 bp, Artificial; identical to SEQ ID NO: 5089
  TaSBEIIa  allele with mutations introduced by TALEN pair TaSBEIIa_T01

SEQ ID NO: 6028 - DNA, 471 bp, Artificial
  TaSBEIIa  allele with mutations introduced by TALEN pair TaSBEIIa_T01
  misc_feature (381): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcggtgggggagaaaccgcgagttgtcccaaaaccaggagatgggcagaaaatatacgagattgacccaacacagattttcggagccatcttgactaccggtaatgcctacccgctgctttcgctcattttgaattaaggtccttnatcatgcaaatttggggaacatcaaagagacaaagactagggaccaccatttcatacagactcccctcgtggtctgagaatatgctggga

SEQ ID NO: 6029 - DNA, 472 bp, Artificial; identical to SEQ ID NO: 5925
  TaSBEIIa  allele with mutations introduced by TALEN pair TaSBEIIa_T01

SEQ ID NO: 6030 - DNA, 462 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctaccgctactttcgctcatttgaattaaggtccttacgtcatgcaaatttgggaacatcaaagagacaaagactagggaccactatttctacagttcccctcatggtctgagaatatgctggga

SEQ ID NO: 6031 - DNA, 471 bp, Artificial
  TaSBEIIa  allele with mutations introduced by TALEN pair TaSBEIIa_T01
  misc_feature (449): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgttttcggagccatcttgactaccggtaatgcctacccgctaatttcgctcattttgaattaaggtcctttcatcatgcaaatttggggaacatcaaagaggcaaagactagggaccactatttcatacagttcccctnatggtctgagaatatgctggga

SEQ ID NO: 6032 - DNA, 467 bp, Artificial; identical to SEQ ID NO: 5877
  TaSBEIIa  allele with mutations introduced by TALEN pair TaSBEIIa_T01

SEQ ID NO: 6033 - DNA, 468 bp, Artificial; identical to SEQ ID NO: 5234
  TaSBEIIa  allele with mutations introduced by TALEN pair TaSBEIIa_T01

SEQ ID NO: 6034 - DNA, 463 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctaccgctactttcgctcatttgaattaaggtcctttcgtcatgcaaatttgggaacatcaaagagacaaagactagggaccactatttcttacacgttccctcatggtctgagaatatgctggga

SEQ ID NO: 6035 - DNA, 472 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6036 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttgggaacatcaaagagaacaaagactagggaccactatttcttacagttcccctcatggtctgagaatatgctggga

SEQ ID NO: 6037 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcatttgaattaaggtcctttcattcatgcaaatttggggaacatcaaagagacaaagactagggaccaccatttcatacagatcccctcgtggtctgagaatatgctggga

SEQ ID NO: 6038 - DNA, 467 bp, Artificial; identical to SEQ ID NO: 5092
  TaSBEIIa  allele with mutations introduced by TALEN pair TaSBEIIa_T01

SEQ ID NO: 6039 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaagggactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgaagaatatgctggga

SEQ ID NO: 6040 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 6041 - DNA, 469 bp, Artificial
  TaSBEIIa  allele with mutations introduced by TALEN pair TaSBEIIa_T01
  misc_feature (457): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctganaatatgctggga

SEQ ID NO: 6042 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcattttgaattaaggtcctttcatcatgcaaatttggggaacatcaaagagacaaagactagggaccaccatttcatacagactcccctcgtggtctgagaatatgctggga

SEQ ID NO: 6043 - DNA, 510 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacaggcgctggagacggtccagcggctgttgccggtgctgtgccaggcccacggcttgccccccagccaggtggtggccatgctggccgatcttgactaccggtaatgcctacccgctgctttcgctcattttgaattaaggtcctttcatcatgctaaattggggaacatacaaagagacaaagactaggaccaccattacattaa

SEQ ID NO: 6044 - DNA, 469 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtcccaaaaccaggagatgggcagaaaatatacgagattgacccaacgctgaattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6045 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatataacgagattgacccaacgtcttttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 6046 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatagctggga

SEQ ID NO: 6047 - DNA, 470 bp, Artificial; identical to SEQ ID NO: 5112
  TaSBEIIa  allele with mutations introduced by TALEN pair TaSBEIIa_T01

SEQ ID NO: 6048 - DNA, 467 bp, Artificial; identical to SEQ ID NO: 5205
  TaSBEIIa  allele with mutations introduced by TALEN pair TaSBEIIa_T01

SEQ ID NO: 6049 - DNA, 466 bp, Artificial; identical to SEQ ID NO: 5247
  TaSBEIIa  allele with mutations introduced by TALEN pair TaSBEIIa_T01

SEQ ID NO: 6050 - DNA, 469 bp, Artificial; identical to SEQ ID NO: 5134
  TaSBEIIa  allele with mutations introduced by TALEN pair TaSBEIIa_T01

SEQ ID NO: 6051 - DNA, 469 bp, Artificial; identical to SEQ ID NO: 5298
  TaSBEIIa  allele with mutations introduced by TALEN pair TaSBEIIa_T01

SEQ ID NO: 6052 - DNA, 469 bp, Artificial; identical to SEQ ID NO: 5084
  TaSBEIIa  allele with mutations introduced by TALEN pair TaSBEIIa_T01

SEQ ID NO: 6053 - DNA, 468 bp, Artificial; identical to SEQ ID NO: 5091
  TaSBEIIa  allele with mutations introduced by TALEN pair TaSBEIIa_T01

SEQ ID NO: 6054 - DNA, 472 bp, Artificial
  TaSBEIIa  allele with mutations introduced by TALEN pair TaSBEIIa_T01
tcagatggatgtgcattactagcaagaacttcacgaaataatgcactgtttgtggtttcgttagtctgctctacaattgctatttttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccggctactttcgctcattttgaattaaggtcctttcgtcatgcaaatttggggaacatcaaagagacaaagactagggaccactatttcttacagttcccctcatggtctgagaatatgctggga

SEQ ID NO: 6055 - DNA, 469 bp, Artificial
  TaSBEIIa  allele with mutations introduced by TALEN pair TaSBEIIa_T01
  misc_feature (445): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagacaaagactagggaccactatttcttacagttccccnctatggtctgagaatatgctggga

SEQ ID NO: 6056 - DNA, 464 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctttttcggagccatcttgactaccggtaatgcctacccgctactttcgctcattttgaattaaggtcctttcgtcatgcaatttgggaacatcaaagagacaaagactagggaccactatttctacagttcccctcatggtctgagaatatgctggga

SEQ ID NO: 6057 - DNA, 468 bp, Artificial; identical to SEQ ID NO: 5219
  TaSBEIIa  allele with mutations introduced by TALEN pair TaSBEIIa_T01

SEQ ID NO: 6058 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgatttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 6059 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcggtgggggagaaaccgcgagttgtcccaaaaccaggagatgggcagaaaatatacgagattgacccaagattttcggagccatcttgactaccggtaatgcctacccgctgctttcgctcattttgaattaaggtcctttcattcatgcaaatttggggaacatcaaagagacaaagactagggaccaccatttcatacagatcccctcgtggtctgagaatatgctggga

SEQ ID NO: 6060 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6061 - DNA, 468 bp, Artificial; identical to SEQ ID NO: 5219
  TaSBEIIa  allele with mutations introduced by TALEN pair TaSBEIIa_T01

SEQ ID NO: 6062 - DNA, 464 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtcatgcaaatttggggaacatcaaagagacaaagactagggaccactattctacagttcccctcatggtctgagaatatgctggga

SEQ ID NO: 6063 - DNA, 469 bp, Artificial; identical to SEQ ID NO: 5194
  TaSBEIIa  allele with mutations introduced by TALEN pair TaSBEIIa_T01

SEQ ID NO: 6064 - DNA, 468 bp, Artificial; identical to SEQ ID NO: 5234
  TaSBEIIa  allele with mutations introduced by TALEN pair TaSBEIIa_T01

SEQ ID NO: 6065 - DNA, 472 bp, Artificial; identical to SEQ ID NO: 5101
  TaSBEIIa  allele with mutations introduced by TALEN pair TaSBEIIa_T01

SEQ ID NO: 6066 - DNA, 468 bp, Artificial; identical to SEQ ID NO: 5234
  TaSBEIIa  allele with mutations introduced by TALEN pair TaSBEIIa_T01

SEQ ID NO: 6067 - DNA, 467 bp, Artificial; identical to SEQ ID NO: 5092
  TaSBEIIa  allele with mutations introduced by TALEN pair TaSBEIIa_T01

SEQ ID NO: 6068 - DNA, 512 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacaggcgctggagacggtccagcggctgttgccggtgctgtgccaggcccacggcttgacccccccagcaggtggtggccattgctggccatcttgactaccggtaatgcctacccgctgctttcgctcattttgaattaggtcctttcatcatgcaaatttggggaacatcaaagagaacaaagactagggaccaccattcattaac

SEQ ID NO: 6069 - DNA, 470 bp, Artificial; identical to SEQ ID NO: 5112
  TaSBEIIa  allele with mutations introduced by TALEN pair TaSBEIIa_T01

SEQ ID NO: 6070 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 6071 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcattttgaattaaggtcctttcattcatgcaaatttggggaacatcaaagagacaaagactagggaccaccatttcatacagatcccctcgtggtctagagaatatgctggga

SEQ ID NO: 6072 - DNA, 468 bp, Artificial; identical to SEQ ID NO: 5463
  TaSBEIIa  allele with mutations introduced by TALEN pair TaSBEIIa_T01

SEQ ID NO: 6073 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgatttcggagccatcttgactaccggtaatgcctacccgctactttcgctcattttgaattaaggtcctttcgtcatgcaaatttggggaacatcaaagagacaaagactagggacaactatttcttacagttcccctcatggtctgagaatatgctggga

SEQ ID NO: 6074 - DNA, 467 bp, Artificial; identical to SEQ ID NO: 5092
  TaSBEIIa  allele with mutations introduced by TALEN pair TaSBEIIa_T01

SEQ ID NO: 6075 - DNA, 467 bp, Artificial; identical to SEQ ID NO: 5148
  TaSBEIIa  allele with mutations introduced by TALEN pair TaSBEIIa_T01

SEQ ID NO: 6076 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccattcatacagatcccctcgtggtctgagaatatgctggga

SEQ ID NO: 6077 - DNA, 467 bp, Artificial; identical to SEQ ID NO: 5877
  TaSBEIIa  allele with mutations introduced by TALEN pair TaSBEIIa_T01

SEQ ID NO: 6078 - DNA, 470 bp, Artificial; identical to SEQ ID NO: 5112
  TaSBEIIa  allele with mutations introduced by TALEN pair TaSBEIIa_T01

SEQ ID NO: 6079 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatactgctggga

SEQ ID NO: 6080 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacaattttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6081 - DNA, 476 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcaagaaaatatacgagattgacccaacgcttgttttcggagccatcttgactaccggtaatgcctacccgcttacttcgctcattttgaaattaaggtcctttcgtcatgctaaatttggggaacatacaaagagaacaaagactagggaccactatttcttacacgttcccctcatggtctgagtaatatgctggga

SEQ ID NO: 6082 - DNA, 468 bp, Artificial; identical to SEQ ID NO: 5089
  TaSBEIIa  allele with mutations introduced by TALEN pair TaSBEIIa_T01

SEQ ID NO: 6083 - DNA, 468 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgttttcggagccatcttgactaccggtaatgcctacccgctactttcgctcattttgaattaaggtcctttcgtcatgcaaatttggggaacatcaaagagaacaaagactagggaccactatttcttacagttccctcatggtctgagaatatgctggga

SEQ ID NO: 6084 - DNA, 470 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaaatatacgagattgacccaacgctgattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6085 - DNA, 467 bp, Artificial; identical to SEQ ID NO: 5555
  TaSBEIIa  allele with mutations introduced by TALEN pair TaSBEIIa_T01

SEQ ID NO: 6086 - DNA, 465 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctgga

SEQ ID NO: 6087 - DNA, 467 bp, Artificial; identical to SEQ ID NO: 5691
  TaSBEIIa  allele with mutations introduced by TALEN pair TaSBEIIa_T01

SEQ ID NO: 6088 - DNA, 466 bp, Artificial; identical to SEQ ID NO: 5277
  TaSBEIIa  allele with mutations introduced by TALEN pair TaSBEIIa_T01

SEQ ID NO: 6089 - DNA, 470 bp, Artificial
  TaSBEIIa  allele with mutations introduced by TALEN pair TaSBEIIa_T01
tcagatggatgtgcattctagcaagaacttcacaacataatgcaccgtttgggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6090 - DNA, 467 bp, Artificial
  TaSBEIIa  allele with mutations introduced by TALEN pair TaSBEIIa_T01
  misc_feature (435): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaagattttcggagccatcttgactaccggtaaatgcctacccgctgctttcgctcattttgaattaaggtcctttcatcatgcaaatttggggaacatcaaagagacaaagactagggaccacatttcatacngaatcccctcgtggtctgagaatatgctggga

SEQ ID NO: 6091 - DNA, 470 bp, Artificial; identical to SEQ ID NO: 5616
  TaSBEIIa  allele with mutations introduced by TALEN pair TaSBEIIa_T01

SEQ ID NO: 6092 - DNA, 469 bp, Artificial
  TaSBEIIa  allele with mutations introduced by TALEN pair TaSBEIIa_T01
tcagatggatgtgcattctagcaagaacttcacaacataatgcaccgtttgggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaaagagacaaagactagggaccaccatttcatacagatcccctcgtggtctgagaatatgctggga

SEQ ID NO: 6093 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaatatacgagattgacccaacactttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6094 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactattttcggagccatcttgactaccggtaatgcctaccgctgctttcgctcattttgaattaaggtcctttcatcatgcaaatttggggaacatcaaagagacaaagactagggaccaccatttcatacagatcccctgtggtctgagaatatgctggga

SEQ ID NO: 6095 - DNA, 466 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccacatttcatacagatcccctcgtggtctgagaatatgctggga

SEQ ID NO: 6096 - DNA, 467 bp, Artificial; identical to SEQ ID NO: 5092
  TaSBEIIa  allele with mutations introduced by TALEN pair TaSBEIIa_T01

SEQ ID NO: 6097 - DNA, 468 bp, Artificial; identical to SEQ ID NO: 5083
  TaSBEIIa  allele with mutations introduced by TALEN pair TaSBEIIa_T01

SEQ ID NO: 6098 - DNA, 469 bp, Artificial; identical to SEQ ID NO: 5571
  TaSBEIIa  allele with mutations introduced by TALEN pair TaSBEIIa_T01

SEQ ID NO: 6099 - DNA, 473 bp, Artificial; identical to SEQ ID NO: 5209
  TaSBEIIa  allele with mutations introduced by TALEN pair TaSBEIIa_T01

SEQ ID NO: 6100 - DNA, 466 bp, Artificial; identical to SEQ ID NO: 5759
  TaSBEIIa  allele with mutations introduced by TALEN pair TaSBEIIa_T01

SEQ ID NO: 6101 - DNA, 466 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctttttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 6102 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcttttcggagccaatcttgactaccggtaatgcctacccgctactttcgctcattttgaattaaggtcctttcgtcatgcaaatttgggaacatcaaagagacaaagactagggaccactatttcttacagtttcccctcatggtctgagaatatgctggga

SEQ ID NO: 6103 - DNA, 471 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttttcggagccatcttgactaccggtaatgcctacccgctgctttcgctcattttgaattaaggtcctttcatcactgcaaatttggggaacatcaaagagacaaagactagggaccaccatttcatacagatcccctcgtggtctgagaactatgcttggga

SEQ ID NO: 6104 - DNA, 466 bp, Artificial; identical to SEQ ID NO: 5145
  TaSBEIIa  allele with mutations introduced by TALEN pair TaSBEIIa_T01

SEQ ID NO: 6105 - DNA, 468 bp, Artificial; identical to SEQ ID NO: 5089
  TaSBEIIa  allele with mutations introduced by TALEN pair TaSBEIIa_T01

SEQ ID NO: 6106 - DNA, 469 bp, Artificial; identical to SEQ ID NO: 5084
  TaSBEIIa  allele with mutations introduced by TALEN pair TaSBEIIa_T01

SEQ ID NO: 6107 - DNA, 464 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgccatcttgactaccggtaatgcctacccgctaatttcgctcattttgaattaaggtccttttcatcatgcaaatttggggaacatcaaagaggacaaagactagggaccactatttcatacagttcccctcatggtctgagaatatgctggga

SEQ ID NO: 6108 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccatttcatacagactcccctcgtggtctgagtaatatgctggga

SEQ ID NO: 6109 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgttttcggagccatcttgactaccggtaatgcctacccgctgctttcgctcattttgaattaaggtcctttcatcatgcaaatttggggaacatcaaagagacaaagactagggaccaccattcatacagatcccctcgtggtctgagaatatgctggga

SEQ ID NO: 6110 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 6111 - DNA, 468 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactattttcggagccatcttgactaccggtaatgcctacccgctgctttcgctcattttgaattaaggtcctttcatcatgcaaatttggggaacatcaaagagacaaagactagggaccaccattcatacagatcccctcgtggtctgagaatatgctggga

SEQ ID NO: 6112 - DNA, 467 bp, Artificial; identical to SEQ ID NO: 5158
  TaSBEIIa  allele with mutations introduced by TALEN pair TaSBEIIa_T01

SEQ ID NO: 6113 - DNA, 471 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaaacaatcactgatggtgtaaccaaaggagttaaggaactagtcgtgggggagaaaccgcgagttgtcccaaaaccaggagatgggcagaaaatatacgagattgacccaacgcttttcggagccatcttgactaccggtaatgcctacccgctactttcgctcattttgaattaaggtcctttcgtctatgctaaatttggggaacatacaaagagaacaaagactagggaccactatttcttacagttcccctcatggtctgagaatatgctggga

SEQ ID NO: 6114 - DNA, 466 bp, Artificial
  TaSBEIIa  allele with mutations introduced by TALEN pair TaSBEIIa_T01
  misc_feature (444): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaaattttcggagccatcttgactaccggtaatgcctacccgctaatttcgctcattttgaattaaggtcctttcatcatgcaaatttgggaacatcaaagaggcaaagactagggaccactatttcatacagttcccctnatggtctgagaatatgctggga

SEQ ID NO: 6115 - DNA, 445 bp, Artificial
  TaSBEIIa  allele with mutations introduced by TALEN pair TaSBEIIa_T01
  misc_feature (247); (272): n is a or c or t or g
tcagatggatgtgcattctagcaagaacttcacaacataatgcaccgtttgggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtggggganaaaccgcgagttgtcccaaaaaccnggagatgggcagaaaatatacgccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6116 - DNA, 338 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttagaatcttcagaaccgactcaaggcattgtggaaacaatcactgatggtgtaaccaaaggagttaaggaactagtcgtggggagaaaccgcgagtcaaatttggggaacatcaaagagacaaagactagggaccactatttcttacagttccctcatggtctgagaatatgctggga

SEQ ID NO: 6117 - DNA, 339 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaatcatcatgcaaatttggggaacatcaaagagacaaagactagggaccaccatttcatacagatcccctcgtggtctgagaatatgctggga

SEQ ID NO: 6118 - DNA, 368 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttcattttgaattaaggtcctttcatcatgcaaatttggggaacatcaaagagacaaagactagggaccaccatttcatacagatcccctcgtggtctgagaatatgctggga

SEQ ID NO: 6119 - DNA, 338 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgaaggtcctttcatcatgcaaatttggggaacatcaaagagacaaagactagggaccaccatttcatacagatcccctcgtggtctgagaatatgctggga

SEQ ID NO: 6120 - DNA, 359 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagaattaaggtcctttcgtcatgcaaatttggggaacatcaaagagacaaagactagggaccactatttcttacagttcccctcatggtctgagaatatgctggga

SEQ ID NO: 6121 - DNA, 350 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttagaatcttcagaaccgactcaaggcattgtggaaacaatcactgatggtgtaaccaaaggagttaaggaactagtcgtggggagaaaccgcgagtcctttcgtcatgcaaatttggggaacatcaaagagacaaagactagggaccactatttcttacagttccctcatggtctgagaatatgctggga

SEQ ID NO: 6122 - DNA, 426 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgcatcttgactaccggtaatgcctacccgctgctttcgctcattttgaattaaggtcctttcatcatgcaaatttggggaacatcaaagagacaaagactagggaccaccatttcatacagatccccctgtggtctgagaatatgctggga

SEQ ID NO: 6123 - DNA, 339 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagtcaaatttggggaacatcaaagagacaaagactagggaccactatttcttacagttcccctcatggtctgagaatatgctggga

SEQ ID NO: 6124 - DNA, 342 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtccaaaatttggggaacatcaaagagacaaagactagggaccactattcttacagttcccctcatggtctgagaatatgctggga

SEQ ID NO: 6125 - DNA, 343 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtccaaatttggggaacatcaaagagacaaagactagggaccactatttcttacagttcccctcatggtctgagaatatgctggga

SEQ ID NO: 6126 - DNA, 366 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6127 - DNA, 337 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgaaggtcctttcatcatgcaaatttggggaacatcaaagagacaaagactagggaccaccatttcatacagatcccctcgtggtctgagaatatgctggga

SEQ ID NO: 6128 - DNA, 443 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgaatgcctacccgctaatttcgctcattttgaattaaggtcctttcatcatgcaaatttggggaacatcaaagaggcaaagacttagggaccactattcatacagttccctcatggtctgagaatatgctggga

SEQ ID NO: 6129 - DNA, 398 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggctgctttcgctcattttgaattaaggtcctttcatcatgcaaatttgggaacatcaaagagacaaagactagggaccaccatttcatacagatcccctgtggtctgagaatatgctggga

SEQ ID NO: 6130 - DNA, 380 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagtcctttcgtcatgcaaatttggggaacatcaaagagacaaagactagggaccactatttcttacagttcccctcatggtctgagaatatgctgggactgagactcaaggcacacagggggatagg

SEQ ID NO: 6131 - DNA, 416 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6132 - DNA, 436 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatcttgactaccggtaatgcctaccgctaatttcgctcattttgaattaaggtcctttcatcatgcaaatttggggaacatcaaagaggcaaagactagggaccactatttcatacagttcccctcatggtctgagaatatgctggga

SEQ ID NO: 6133 - DNA, 397 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgatttcgctcattttgaattaaggtcctttcatcatgcaaatttggggaacatcaaagaggcaaagactagggaccactatttcatacagttcccctcatggtctgagaatatgctgggga

SEQ ID NO: 6134 - DNA, 452 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccatcttgactaccggtaatgcctaccgctaatttcgctcattttgaattaaggtcctttcatcatgcaaatttggggaacatcaaagaggcaaagactagggaccactatttcatacagttcccctcatggtctgagaatatgctggga

SEQ ID NO: 6135 - DNA, 452 bp, Artificial
  TaSBEIIa  allele with mutations introduced by TALEN pair TaSBEIIa_T01
gtcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaggagttaaggaactagtcgtgggggagaaaccgcgagttgtcccaaaaccaggagatgggcagaaaatatacgagattgacccggagccatcttgactaccggtaatgcctaccgctgctttcgctcattttgaattaaggccttcatcatgcaaatttgggaacatcaaagagacaaagactagggaccaccatttcatacagatccctcgtggtctgagaatatgctggga

SEQ ID NO: 6136 - DNA, 351 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactgctttcgctcattttgaattaaggtcctttcatcatgcaaatttggggaacatcaaagagacaaagactagggaccaccatttcatacagatcccctgtggtctgagaatatgctggga

SEQ ID NO: 6137 - DNA, 265 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaacttgaatcttcagaaccgactcaaggcaatttggggaacatcaaagagacaaagactagggaccactatttcttacagttcccctcatggtctgagaatatgctggga

SEQ ID NO: 6138 - DNA, 442 bp, Artificial
  TaSBEIIa  allele with mutations introduced by TALEN pair TaSBEIIa_T01
  misc_feature (419): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattaccggtaatgcctacccgctaatttcgctcattttgaattaaggtcctttcatcatgcaaatttggggaacatcaaagaggcaaagactagggaccactatttcatacagttccccctanatggtctgagaatatgcgtggga

SEQ ID NO: 6139 - DNA, 334 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcgggggagacatgcaaatttggggaacatcaaagaggcaaagactagggaccactatttcatacagttcccctcatggtctgagaatatgctggga

SEQ ID NO: 6140 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctgggactgagacaaggcacacaggggatagg

SEQ ID NO: 6141 - DNA, 458 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgattttcggagccatcttgactaccggtaatgcctaccgctaatttcgctcattttgaattaaggtcctttcatcatgcaaatttggggaacatcaaagaggcaaagactagggaccactatttcatacagttcccctcatggtctgagaatatgctggga

SEQ ID NO: 6142 - DNA, 456 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6143 - DNA, 449 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctaccgctgctttcgctcattttgaattaaggtcctttcatcatgcaaatttggggaacatcaaagagacaaagactagggaccaccatttcatacagatcccctcgtgtctgagaatatgctggga

SEQ ID NO: 6144 - DNA, 328 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaggtcctttcatcatgcaaatttggggaacatcaaagagacaaagactagggaccaccatttcatacagatcccctcgtggtctgagaatatgctggga

SEQ ID NO: 6145 - DNA, 365 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6146 - DNA, 430 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6147 - DNA, 292 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaatttggggaacatcaaagagacaaagactagggaccactatttcttacagttcccctcatggtctgagaatatgctggga

SEQ ID NO: 6148 - DNA, 397 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgatttcgctcattttgaattaaggtcctttcatcatgcaaatttggggaacatcaaagaggcaaagactagggaccactatttcatacagttcccctcatggtctgagaatatgctggga

SEQ ID NO: 6149 - DNA, 408 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6150 - DNA, 438 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaggagttaaggaactagtcgtgggggagaaaccgcgagttgtcccaaaaccaggagatgggcagaaaatatacgacttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6151 - DNA, 362 bp, Artificial
  TaSBEIIa  allele with mutations introduced by TALEN pair TaSBEIIa_T01
tcagatggatgtattctagcaagaacttcacaacataatgcaccgtttggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6152 - DNA, 425 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcttgactaccggtaatgcctacccgctgctttcgctcattttgaattaaggtcctttcatcatgcaaatttggggaacatcaaagagacaaagactagggaccacatttcatacagatcccctcgtggtctgagaatatgctggga

SEQ ID NO: 6153 - DNA, 412 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagatactttcgctcattttgaattaaggtccttcgtcatgcaaatttggggaacatcaaagagacaaagactaggaccactattcttacagttcccctcatggtctgagaatatgctggga

SEQ ID NO: 6154 - DNA, 339 bp, Artificial; identical to SEQ ID NO: 6123
  TaSBEIIa  allele with mutations introduced by TALEN pair TaSBEIIa_T01

SEQ ID NO: 6155 - DNA, 343 bp, Artificial; identical to SEQ ID NO: 6125
  TaSBEIIa  allele with mutations introduced by TALEN pair TaSBEIIa_T01

SEQ ID NO: 6156 - DNA, 365 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttggggaacatcaaagagacaaagactagggaccactatttcttacagttcccctcatggtctgagaatatgctggga

SEQ ID NO: 6157 - DNA, 337 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagacatgcaaaatttggggaacatcaaagaggcaaagactagggaccactatttcatacagttcccctcatggtctgagaatatgctggga

SEQ ID NO: 6158 - DNA, 391 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtcccaaaaccaggagactttcgctcattttgaattaaggtcctttcgtcatgcaaatttgggaacatcaaagagacaaagactagggaccactatttcttacagttcccctcatggtctgagaatatgctggga

SEQ ID NO: 6159 - DNA, 427 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6160 - DNA, 429 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6161 - DNA, 316 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggacatcaaagaggcaaagactagggaccactatttcatacagttcccctcatggtctgagaatatgctggga

SEQ ID NO: 6162 - DNA, 366 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtacccgctgctttcgctcattttgaattaaggtcctttcatcatgcaaatttggggaacatcaaagagacaaagactagggaccaccatttcataacagatcccctcgtggtctgagaatatgctggga

SEQ ID NO: 6163 - DNA, 365 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgctcattttgaattaaggtcctttcgtcatgcaaatttggggaacatcaaagagacaaagactagggaccactatttcttacagttcccctcatggtctgagaatatgctggga

SEQ ID NO: 6164 - DNA, 422 bp, Artificial
  TaSBEIIa  allele with mutations introduced by TALEN pair TaSBEIIa_T01
  misc_feature (245): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggganaaaccgcgagttgtcccaaaaccaggagactttcgctcattttgaattaaggtcctttcgtcatgcaaatttggggaacatcaaagagacaaagactagggaccactatttcttacagttcccctcatggtctgagaatatgctgggactgagacgccaaggcacacaggggatagg

SEQ ID NO: 6165 - DNA, 364 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtacccgctgctttcgctcattttgaattaaggtcctttcatcatgcaaatttgggaacatcaaagagacaaagactagggaccaccatttcatacagatcccctgtggtctgagaatatgctggga

SEQ ID NO: 6166 - DNA, 335 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgaatttggggaacatcaaagagacaaagactagggaccaccatttcatacagatcccctcgtggtctgagaatatgctggga

SEQ ID NO: 6167 - DNA, 408 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtggggagaaaccgcgagttgtcccaaaaccaggagatgggcagacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6168 - DNA, 437 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6169 - DNA, 381 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgaattaaggtcctttcgtcatgcaaattttggggaacatcaaagagacaaagactagggaccactatttcttacagttcccctcatggtctgagaatatgctggga

SEQ ID NO: 6170 - DNA, 436 bp, Artificial
  TaSBEIIa  allele with mutations introduced by TALEN pair TaSBEIIa_T01
  misc_feature (375): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagctaccggtaatgcctacccgctgctttcgctcattttgaattaaggtcctttcatcatgcaaatttggggaacatcaaagngacaaagactagggaccaccatttcatacagatcccctcgtggtctgagaatatgctggga

SEQ ID NO: 6171 - DNA, 328 bp, Artificial; identical to SEQ ID NO: 6144
  TaSBEIIa  allele with mutations introduced by TALEN pair TaSBEIIa_T01

SEQ ID NO: 6172 - DNA, 313 bp, Artificial
  TaSBEIIa  allele with mutations introduced by TALEN pair TaSBEIIa_T01
  misc_feature (219): n is a or c or t or g
tcagatggatgtgcattctagcaagaacttcacgaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggngttaaggaactagtcgtgggggaacatcaaagagacaaaagactagggaccactatttcttacagttccctcatggtctgagaatatgctggga

SEQ ID NO: 6173 - DNA, 439 bp, Artificial
  TaSBEIIa  allele with mutations introduced by TALEN pair TaSBEIIa_T01
  misc_feature (269): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccnggagatgggcagaaaatataatcttgaactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6174 - DNA, 437 bp, Artificial; identical to SEQ ID NO: 6168
  TaSBEIIa  allele with mutations introduced by TALEN pair TaSBEIIa_T01

SEQ ID NO: 6175 - DNA, 366 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttggggaacatcaaagagacaaagactagggaccactatttcttacagttcccctcatggtctgagaatatgctggga

SEQ ID NO: 6176 - DNA, 438 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6177 - DNA, 427 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgcatcttgactaccggtaatgcctacccgctgctttcgctcattttgaattaaggtcctttcatcatgcaaatttggggaacatcaaagagataaagactagggaccaccatttcatacagatcccctcgtggtctgagaatatgctggga

SEQ ID NO: 6178 - DNA, 440 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6179 - DNA, 313 bp, Artificial
  TaSBEIIa  allele with mutations introduced by TALEN pair TaSBEIIa_T01
tcagatggatgtgcattctagcaagaacttcacaaataatgcactgtttgtggtttcgtttgtctgctctacgattgctattttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactaatttggggaacatcaaagaggcaaagactagggaccactatttcatacagttcccctcatggtctgagaatatgctggga

SEQ ID NO: 6180 - DNA, 444 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaatatacgagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6181 - DNA, 372 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgctgctttcgctcattttgaattaaggtcctttcatcatgcaaatttgggaacatcaaagagacaaagactagggaccaccatttcatacagatcccctcgtggtctgagaatatgctggga

SEQ ID NO: 6182 - DNA, 400 bp, Artificial
  TaSBEIIa  allele with mutations introduced by TALEN pair TaSBEIIa_T01
  misc_feature (378): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagctttcgctcattttgaattaaggtcctttcgtcatgcaaatttggggaacatcaaagagacaaagactagggaccactatttcttacagttcccctnatggtctgagaatatgctggga

SEQ ID NO: 6183 - DNA, 379 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcctttcgctcattttgaattaaggtcctttcgtcatgcaaatttggggaacatcaaagagacaaagactagggaccactatttcttacagttcccctcatggtctgagaatatgctggga

SEQ ID NO: 6184 - DNA, 316 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactaatttggggaacatcaaagaggcaaagactagggaccactatttcatacagttcccctcatggtctgagaatatgctggga

SEQ ID NO: 6185 - DNA, 429 bp, Artificial; identical to SEQ ID NO: 6160
  TaSBEIIa  allele with mutations introduced by TALEN pair TaSBEIIa_T01

SEQ ID NO: 6186 - DNA, 422 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 6187 - DNA, 362 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaggagttaaggaactagtcgtacccgctgctttcgctcattttgaattaaggtcctttcatcatgcaaatttgggaacatcaaagagacaaagactagggaccaccatttcatacagatcccctgtggtctgagaatatgctggga

SEQ ID NO: 6188 - DNA, 466 bp, Artificial
  TaSBEIIa  allele with mutations introduced by TALEN pair TaSBEIIa_T01
tcagatggatgtgttctagcaagaacttcacaacataatgcaccgtttggggtttcgtcagtctgctctacaattgctattttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6189 - DNA, 456 bp, Artificial
  TaSBEIIa  allele with mutations introduced by TALEN pair TaSBEIIa_T01
  misc_feature (434): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaagcatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccatcttgactaccggtaatgcctacccgctactttcgctcattttgaattaaggtcctttcgtcatgcaaatttggggaacatcaaagagacaaagactagggaccactatttcttacagttcccctnatggtctgagaatatgctggga

SEQ ID NO: 6190 - DNA, 424 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6191 - DNA, 454 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 6192 - DNA, 376 bp, Artificial
  TaSBEIIa  allele with mutations introduced by TALEN pair TaSBEIIa_T01
tcagaggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaacttgaatcttcagaaccgactcaaggcattgtggaaacaatcactgatggtgtaaccaaaggagttaaggaactagtcgtgggggagaaaccgcgagttgtcctttcgctcattttgaattaaggtcctttcgtcatgcaaatttggggaacatcaaagagacaaagactagggaccactatttcttacagttcccctcatggtctgagaatatgctggga

SEQ ID NO: 6193 - DNA, 365 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttggggaacatcaaagagacaaagactagggaccactatttcttacagttccctcatggtctgagaatatgctggga

SEQ ID NO: 6194 - DNA, 380 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgaattaaggtcctttcgtcatgcaaatttggggaacatcaaagagacaaagactagggaccactatttcttacagttcccctcatggtctgagaatatgctggga

SEQ ID NO: 6195 - DNA, 425 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacatgcctacccgctgctttcgctcattttgaattaaggtcctttcatcatgcaaagtttggggaacatcaaagagacaaagactagggaccaccatttcatacagatcccctcgtggtctgagaatatgctggga

SEQ ID NO: 6196 - DNA, 365 bp, Artificial; identical to SEQ ID NO: 6193
  TaSBEIIa  allele with mutations introduced by TALEN pair TaSBEIIa_T01

SEQ ID NO: 6197 - DNA, 374 bp, Artificial
  TaSBEIIa  allele with mutations introduced by TALEN pair TaSBEIIa_T01
  misc_feature (352): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcaagaaaatataaatttggggaacatcaaagaggcaaagactagggaccactatttcatacagttcccctnatggtctgagaatatgctggga

SEQ ID NO: 6198 - DNA, 352 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactgctttcgctcattttgaattaaggtcctttcatcatgcaaatttggggaacatcaaagagacaaagactagggaccaccatttcatacagatcccctcgtggtctgagaatatgctggga

SEQ ID NO: 6199 - DNA, 447 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtacccaaaaccaggagatgggcagaaaatatacgagattgcatcttgactaccggtaatgcctaccgctgctttcgctcattttgaattaaggtcctttcatcatgcaaatttggggaacatcaaagagacaaagactagggaccaccattcatacagatcccctcgtggtctgagaatatgctggga

SEQ ID NO: 6200 - DNA, 365 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttgggaacatcaaagagacaaagactagggaccactatttcttacagttcccctcatggtctgagaatatgctggga

SEQ ID NO: 6201 - DNA, 379 bp, Artificial; identical to SEQ ID NO: 6183
  TaSBEIIa  allele with mutations introduced by TALEN pair TaSBEIIa_T01

SEQ ID NO: 6202 - DNA, 462 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgcggagccatcttgactaccggtaatgcctaccgctaatttcgctcattttgaattaaggtcctttcatcatgcaaatttgggaacatcaaagaggcaaagactagggaccactatttcatacagttcccctcatggtctgagaatatgctggga

SEQ ID NO: 6203 - DNA, 456 bp, Artificial; identical to SEQ ID NO: 6142
  TaSBEIIa  allele with mutations introduced by TALEN pair TaSBEIIa_T01

SEQ ID NO: 6204 - DNA, 426 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgcatcttgactaccggtaatgcctacccgctgctttcgctcattttgaattaaggtcctttcatcatgcaaatttggggaacatcaaagagacaaagactagggaccaccatttcatacagatcccctcgtggtctgagaattgctggga

SEQ ID NO: 6205 - DNA, 400 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagctttcgctcattttgaattaaggtcctttcgtcatgcaaatttggggaacatcaaagagacaaagactagggaccactatttcttacagttcccctcatggtctgagaatatgctggga

SEQ ID NO: 6206 - DNA, 426 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaataccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6207 - DNA, 380 bp, Artificial; identical to SEQ ID NO: 6194
  TaSBEIIa  allele with mutations introduced by TALEN pair TaSBEIIa_T01

SEQ ID NO: 6208 - DNA, 465 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacatttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6209 - DNA, 350 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactgctttcgctcattttgaattaaggtcctttcatcatgcaaatttgggaacatcaaagagacaaagactagggaccaccatttcatacagatcccctgtgtctgagaatatgctggga

SEQ ID NO: 6210 - DNA, 393 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagactttcgctcattttgaattaaggtcctttcgtcatgcaaatttggggaacatcaaagagacaaagactagggaccactatttcttacagttcccctcatggtctgagaatatgctggga

SEQ ID NO: 6211 - DNA, 454 bp, Artificial; identical to SEQ ID NO: 6191
  TaSBEIIa  allele with mutations introduced by TALEN pair TaSBEIIa_T01

SEQ ID NO: 6212 - DNA, 334 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtcctttcatcatgcaaatttggggaacatcaaagagacaaagactagggaccaccatttcatacagatcccctcgtggtctgagaatatgctggga

SEQ ID NO: 6213 - DNA, 420 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6214 - DNA, 439 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgacttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6215 - DNA, 380 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgacccgctactttcgctcattttgaattaaggtcctttcgtcatgcaaatttggggaacatcaaagagacaaagactagggaccactatttcttacagttcccctcatggtctgagaatatgctggga

SEQ ID NO: 6216 - DNA, 344 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtccaaaatttggggaacatcaaagagacaaagactagggaccactatttcttacagttcccctcatggtctgagaatatgctggga

SEQ ID NO: 6217 - DNA, 421 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6218 - DNA, 429 bp, Artificial; identical to SEQ ID NO: 6160
  TaSBEIIa  allele with mutations introduced by TALEN pair TaSBEIIa_T01

SEQ ID NO: 6219 - DNA, 449 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctaccgctgctttcgctcattttgaattaaggtcctttcatcatgcaaatttggggaacatcaaagagacaaagactaggaccaccatttcatacagatcccctcgtggtctgagaatatgctggga

SEQ ID NO: 6220 - DNA, 467 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgaaagagccatcttgactaccggtaatgcctacccgctaatttcgctcattttgaattaaggtcctttcatcatgcaaatttggggaacatcaaagaggcaaagactagggaccactattcatacagttcccctcatggtctgagaatatgatggga

SEQ ID NO: 6221 - DNA, 424 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacggtaatgcctacccgctactttcgctcattttgaattaggtcctttcgtcatgcaaatttggggaacatcaaagagacaaagactagggaccactattcttacagttccctcatggtctgagaatatgctggga

SEQ ID NO: 6222 - DNA, 439 bp, Artificial; identical to SEQ ID NO: 6214
  TaSBEIIa  allele with mutations introduced by TALEN pair TaSBEIIa_T01

SEQ ID NO: 6223 - DNA, 466 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6224 - DNA, 438 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgacttgactaccggtatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6225 - DNA, 465 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgaaagccatcttgactaccggtaatgcctaccgctaatttcgctcattttgaattaaggtcctttcatcatgcaaatttggggaacatcaaagaggcaaagactagggaccactatttcatacagttcccctcatggtctgagaatatgctggga

SEQ ID NO: 6226 - DNA, 366 bp, Artificial; identical to SEQ ID NO: 6175
  TaSBEIIa  allele with mutations introduced by TALEN pair TaSBEIIa_T01

SEQ ID NO: 6227 - DNA, 446 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6228 - DNA, 451 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaataaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6229 - DNA, 401 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagctttcgctcattttgaattaaggtcctttcgtcatgcaaaatttggggaacatcaaagagacaaagactagggaccactatttcttacagttcccctcatggtctgagaatatgctggga

SEQ ID NO: 6230 - DNA, 438 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacgaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6231 - DNA, 398 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtggggagaaaccgcgagttgtcccaaaacctacccgctgctttcgctcattttgaattaaggtccttttcatcatgcaaattttggggaacatcaaagagacaaagactagggaccaccatttcatacagatcccctcgtggtctgagaatatgctggga

SEQ ID NO: 6232 - DNA, 470 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaaccaggagatgggcagaaaatatacgagattgacccaacgcttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6233 - DNA, 454 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6234 - DNA, 380 bp, Artificial; identical to SEQ ID NO: 6194
  TaSBEIIa  allele with mutations introduced by TALEN pair TaSBEIIa_T01

SEQ ID NO: 6235 - DNA, 449 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaggtaatgcctacccgctgctttcgctcattttgaattaaggtcctttcatcatgcaaatttggggaacatcaaagagacaaagactagggaccaccatttcatacagatcccctcgtggtctgagaatatgctgggactagactgccaaggcacacaggggatagg

SEQ ID NO: 6236 - DNA, 465 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactcggagccatcttgactaccggtaatgcctacccgctgctttcgctcatttttgaattaaggtcctttcatcatgcaaatttggggaacatcaaagagacaaagactagggaccaccatttcatacagatcccctcgtggtctgagaatatgctggga

SEQ ID NO: 6237 - DNA, 456 bp, Artificial; identical to SEQ ID NO: 6142
  TaSBEIIa  allele with mutations introduced by TALEN pair TaSBEIIa_T01

SEQ ID NO: 6238 - DNA, 415 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagatatgctggga

SEQ ID NO: 6239 - DNA, 338 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagtcaaatttgggaacatcaaagagacaaagactagggaccactatttcttacagttcccctcatggtctgagaatatgctggga

SEQ ID NO: 6240 - DNA, 446 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaattttcggagccatcttgactaccggtaatgcctaccgctaatttcgctcattttgaattaaggtcctttcatcatgcaaatttggggaacatcaaagaggcaaagactagggaccactatttcatacagttcccctcatggtctgagaatatgctggga

SEQ ID NO: 6241 - DNA, 379 bp, Artificial; identical to SEQ ID NO: 6183
  TaSBEIIa  allele with mutations introduced by TALEN pair TaSBEIIa_T01

SEQ ID NO: 6242 - DNA, 464 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacatttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 6243 - DNA, 452 bp, Artificial; identical to SEQ ID NO: 6134
  TaSBEIIa  allele with mutations introduced by TALEN pair TaSBEIIa_T01

SEQ ID NO: 6244 - DNA, 454 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 6245 - DNA, 380 bp, Artificial; identical to SEQ ID NO: 6215
  TaSBEIIa  allele with mutations introduced by TALEN pair TaSBEIIa_T01

SEQ ID NO: 6246 - DNA, 339 bp, Artificial; identical to SEQ ID NO: 6123
  TaSBEIIa  allele with mutations introduced by TALEN pair TaSBEIIa_T01

SEQ ID NO: 6247 - DNA, 422 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 6248 - DNA, 340 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttagaatcttcagaaccgactcaaggcattgtggaaacaatcactgatggtgtaaccaaaggagttaaggaactagtcgtgggggagaaaccgcgagtcaaatttggggaacatcaaagagacaaagactagggaccactatttcttacagttcccctcatggtctgagaatatgctggga

SEQ ID NO: 6249 - DNA, 448 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctaccgctactttcgctcattttgaattaaggtcctttcgtcatgcaaatttggggaacatcaaagagacaaagactagggaccactattcttacagttcccctcatggtctgagaatatgctggga

SEQ ID NO: 6250 - DNA, 405 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagatattttgaattaaggtcctttcgtcatgcaaatttggggaacatcaaagagacaaagactagggaccactatttcttacagttcccctcatggtctgagaatatgctggga

SEQ ID NO: 6251 - DNA, 451 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctacccgctgctttcgctcattttgaatttaaggtcctttcatcatgcaaatttggggaacatcaaagagacaaagactagggaccaccatttcatacagatcccctcgtggtctgagaatatgctggga

SEQ ID NO: 6252 - DNA, 445 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 6253 - DNA, 428 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctaatttcgctcattttgaattaaggtcctttcatcatgcaaatttgggaacatcaaagaggcaaagactagggaccactatttcatacagttcccctcatggtctgagaatatgctggga

SEQ ID NO: 6254 - DNA, 379 bp, Artificial; identical to SEQ ID NO: 6183
  TaSBEIIa  allele with mutations introduced by TALEN pair TaSBEIIa_T01

SEQ ID NO: 6255 - DNA, 379 bp, Artificial; identical to SEQ ID NO: 6183
  TaSBEIIa  allele with mutations introduced by TALEN pair TaSBEIIa_T01

SEQ ID NO: 6256 - DNA, 422 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggttgactaccggtaatgcctacccgctactttcgctcattttgaattaaggtccttcgtcatgcaaatttggggaacatcaaagagacaaagactagggaccactatttcttacagttcccctcatggtctgagaatatgctggga

SEQ ID NO: 6257 - DNA, 446 bp, Artificial; identical to SEQ ID NO: 6227
  TaSBEIIa  allele with mutations introduced by TALEN pair TaSBEIIa_T01

SEQ ID NO: 6258 - DNA, 366 bp, Artificial; identical to SEQ ID NO: 6175
  TaSBEIIa  allele with mutations introduced by TALEN pair TaSBEIIa_T01

SEQ ID NO: 6259 - DNA, 465 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6260 - DNA, 429 bp, Artificial; identical to SEQ ID NO: 6160
  TaSBEIIa  allele with mutations introduced by TALEN pair TaSBEIIa_T01

SEQ ID NO: 6261 - DNA, 339 bp, Artificial; identical to SEQ ID NO: 6123
  TaSBEIIa  allele with mutations introduced by TALEN pair TaSBEIIa_T01

SEQ ID NO: 6262 - DNA, 452 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagatttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 6263 - DNA, 366 bp, Artificial; identical to SEQ ID NO: 6126
  TaSBEIIa  allele with mutations introduced by TALEN pair TaSBEIIa_T01

SEQ ID NO: 6264 - DNA, 449 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgcatcttgactaccggtaatgcctacccgctactttcgctcattttgaattaaggtcctttcgtcatgcaaattttggggaacatcaaagagacaaagactagggaccactatttcttacagttcccctcatggtactgagaatatgctggga

SEQ ID NO: 6265 - DNA, 459 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgattttcggagccatcttgactaccggtaatgcctacccgctaatttcgctcattttgaattaaggtcctttcatcatgcaaatttgggaacatcaaagaggcaaagactagggaccactattcatacagttcccctcatggtctgagaatatgctggga

SEQ ID NO: 6266 - DNA, 456 bp, Artificial
  TaSBEIIa  allele with mutations introduced by TALEN pair TaSBEIIa_T01
  misc_feature (290): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatntacgagattgttttcggagccatcttgactaccggtaatgcctacccgctaatttcgctcattttgaattaggtccttcatcatgcaaattgggaacatcaaagaggcaaagactagggaccactatttcatacagttcccctcatggtctgagaatatgctggga

SEQ ID NO: 6267 - DNA, 445 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6268 - DNA, 450 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6269 - DNA, 406 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 6270 - DNA, 435 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagactaccggtaatgcctaccgctgctttcgctcattttgaattaaggtcctttcatcatgcaaatttgggaacatcaaagagacaaagactagggaccaccatttcatacagatcccctcgtggtctgagaatatgctggga

SEQ ID NO: 6271 - DNA, 339 bp, Artificial
  TaSBEIIa  allele with mutations introduced by TALEN pair TaSBEIIa_T01
  misc_feature (317): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagtcaaatttggggaacatcaaagagacaaagactagggaccactatttcttacagttcccctnatggtctgagaatatgctggga

SEQ ID NO: 6272 - DNA, 435 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatggtcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 6273 - DNA, 451 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggacagaaaatatacgagattgacccaacgttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6274 - DNA, 450 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattggagccatcttgactaccggtaatgcctaccgctgctttcgctcattttgaattaaggtcctttcatcatgcaaatttgggaacatcaaagagacaaagactagggaccaccatttcatacagatcccctcgtggtctgagaatatgctggga

SEQ ID NO: 6275 - DNA, 449 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6276 - DNA, 395 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgatttcgctcattttgaattaaggtccttcatcatgcaaatttggggaacatcaaagaggcaaagactagggaccactattcatacagttcccctcatggtctgagaatatgctggga

SEQ ID NO: 6277 - DNA, 452 bp, Artificial; identical to SEQ ID NO: 6134
  TaSBEIIa  allele with mutations introduced by TALEN pair TaSBEIIa_T01

SEQ ID NO: 6278 - DNA, 420 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6279 - DNA, 367 bp, Artificial
  TaSBEIIa  allele with mutations introduced by TALEN pair TaSBEIIa_T01
  misc_feature (344): n is a or c or t or g
tcagatggatgtgcattctagcaagaacttcacgaaataatgcactgtttgtggtttcgttagtctgctctacaattgctattttcgtgctatagatacctgaagacatcgaggaacaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttggggaacatcaaagagacaaagactagggaccactatttcttacagttcccctnatggtctgagaatatgcgtggga

SEQ ID NO: 6280 - DNA, 449 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattagccatcttgactaccggtaatgcctacccgctgctttcgctcattttgaattaaggtcctttcatcatgcaaatttggggaacatcaaagagacaaagactagggacaccatttcatacagatcccctcgtggtctgagaatatgctggga

SEQ ID NO: 6281 - DNA, 445 bp, Artificial; identical to SEQ ID NO: 6267
  TaSBEIIa  allele with mutations introduced by TALEN pair TaSBEIIa_T01

SEQ ID NO: 6282 - DNA, 402 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgcccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6283 - DNA, 363 bp, Artificial
  TaSBEIIa  allele with mutations introduced by TALEN pair TaSBEIIa_T01
tcagatggatgtgattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttggggaacatcaaagagacaaagactagggaccactatttcttacagttccctcatggtctgagaatatgctggga

SEQ ID NO: 6284 - DNA, 448 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 6285 - DNA, 435 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatcttgactaccggtaatgcctaccgctaatttcgctcattttgaattaaggtcctttcatcatgcaaatttgggaacatcaaagaggcaaagactagggaccactatttcatacagttcccctcatggtctgagaatatgctggga

SEQ ID NO: 6286 - DNA, 415 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagatactttcgctcattttgaattaaggtcctttcgtcatgcaaatttggggaacatcaaagagacaaagactagggaccactatttcttacagttcccctcatggtctgagaatatgctggga

SEQ ID NO: 6287 - DNA, 337 bp, Artificial; identical to SEQ ID NO: 6157
  TaSBEIIa  allele with mutations introduced by TALEN pair TaSBEIIa_T01

SEQ ID NO: 6288 - DNA, 446 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtataaccaaaggagttaaggaactagtcgtgggggagaaaccgcgagttgtcccaaaaccaggagatgggcagaaaatatacgagattgaccttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6289 - DNA, 379 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgaattaaggtcctttcgtcatgcaaatttggggaacatcaaagagacaaagactagggaccactattcttacagttcccctcatggtctgagaatatgctggga

SEQ ID NO: 6290 - DNA, 373 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatataaatttggggaacatcaaagaggcaaagactagggaccactatttcatacagttcccctcatggtctgagaatatgctggga

SEQ ID NO: 6291 - DNA, 483 bp, Artificial
  TaSBEIIa  allele with mutations introduced by TALEN pair TaSBEIIa_T01
tcagatggagtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctacccgctgcttttcgctcattttgaattaaggtcctttcatcatgcaaatttggggaacatcaaagagacaaagactagggaccaccatttcatacagatcccctcgtggtctgagaatatgctgggactgacgtgtcacgacgacacacggaggagagg

SEQ ID NO: 6292 - DNA, 341 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtccaaaatttggggaacatcaaagagacaaagactaggaccactattcttacagttccctcatggtctgagaatatgctggga

SEQ ID NO: 6293 - DNA, 445 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccggtaatgcctacccgctactttcgctcattttgaattaaggtccttttcgtcatgcaaatttggggaacatcaaagagacaaagactagggaccactatttcttacagttcccctcatggtctgagaatatgctggga

SEQ ID NO: 6294 - DNA, 429 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccctaccgctactttcgctcattttgaattaaggtcctttcgtcatgcaaattttggggaacatcaaagagacaaagactagggaccactatttcttacagttcccctcatggtctgagaatatgctggga

SEQ ID NO: 6295 - DNA, 455 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatgatgtaaccaaaggagttaaggaactagtcgtgggggagaaaccgcgagttgtcccaaaaccaggagatgggcagaaaatatacgagattgactcggagccatcttgactaccggtaatgcctacccgctgctttcgctcattttgaattaggtcctttcatcatgcaaatttgggaacatcaaagagacaaagactagggaccaccatttcatacagatcccctcgtggtctgagaatatgctggga

SEQ ID NO: 6296 - DNA, 450 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 6297 - DNA, 385 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6298 - DNA, 343 bp, Artificial; identical to SEQ ID NO: 6125
  TaSBEIIa  allele with mutations introduced by TALEN pair TaSBEIIa_T01

SEQ ID NO: 6299 - DNA, 466 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgaaagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6300 - DNA, 450 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgccatcttgactaccggtaatgcctacccgctaatttcgctcattttgaattaaggtcctttcatcatgcaaatttggggaacatcaaagaggcaaagactagggaccactattcatacagttcccctcatggtctgagaatatgctggga

SEQ ID NO: 6301 - DNA, 339 bp, Artificial; identical to SEQ ID NO: 6123
  TaSBEIIa  allele with mutations introduced by TALEN pair TaSBEIIa_T01

SEQ ID NO: 6302 - DNA, 436 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagctaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6303 - DNA, 414 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagctactttcgctcattttgaattaaggtcctttcgtcatgcaaatttggggaacatcaaagagacaaagactagggaccactatttcttacagttccctcatggtctgagaatatgctggga

SEQ ID NO: 6304 - DNA, 449 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctaccgctgctttcgctcattttgaattaaggtcctttcatcatgcaaatttggggaacatcaaagagacaaagactaggaccacattcatacagatccctcgtggtctgagaatatgctggga

SEQ ID NO: 6305 - DNA, 420 bp, Artificial; identical to SEQ ID NO: 6278
  TaSBEIIa  allele with mutations introduced by TALEN pair TaSBEIIa_T01

SEQ ID NO: 6306 - DNA, 451 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgaccccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6307 - DNA, 408 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtacccaaaaccaggagatgggcaagaaaatatacgacattttgaattaaggtcctttcatcatgcaaatttggggaacatcaaagaggcaaagactagggaccactatttcatacagttcccctcatggtctgagaatatgctggga

SEQ ID NO: 6308 - DNA, 447 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgcaccggtaatgcctaccgctaattcgctcattttgaattaaggtcctttcatcatgcaaatttggggaacatcaaagaggcaaagactagggaccactatttcatacagttcccctcatggtctgagaatatgctggga

SEQ ID NO: 6309 - DNA, 337 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagtcaaatttggggaacatcaaagagacaaagactagggaccactattcttacagttccctcatggtctgagaatatggctggga

SEQ ID NO: 6310 - DNA, 449 bp, Artificial; identical to SEQ ID NO: 6275
  TaSBEIIa  allele with mutations introduced by TALEN pair TaSBEIIa_T01

SEQ ID NO: 6311 - DNA, 452 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcatcttgactaccggtaatgcctaccgctactttcgctcattttgaattaaggtcctttcgtcatgcaaatttggggaacatcaaagagacaaagactagggaccactattcttacagttcccctcatggtctgagaatatgctggga

SEQ ID NO: 6312 - DNA, 427 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgcatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6313 - DNA, 406 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgacattttgaattaaggtcctttcatcatgcaaatttggggaacatcaaagaggcaaagactagggaccactatttcatacagttcccctcatggtctgagaatatgctggga

SEQ ID NO: 6314 - DNA, 366 bp, Artificial; identical to SEQ ID NO: 6126
  TaSBEIIa  allele with mutations introduced by TALEN pair TaSBEIIa_T01

SEQ ID NO: 6315 - DNA, 316 bp, Artificial; identical to SEQ ID NO: 6184
  TaSBEIIa  allele with mutations introduced by TALEN pair TaSBEIIa_T01

SEQ ID NO: 6316 - DNA, 448 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaaagataatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6317 - DNA, 441 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6318 - DNA, 453 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgttccaaaaccaggagatgggcagaaaatatacgagattttcggagccatcttgactaccggtaatgcctaccgctgctttcgctcattttgaattaaggtcctttcatcatgcaaatttgggaacatcaaaagagacaaagactagggaccaccatttcatacagatcccctgtggtctgagaatatgctggga

SEQ ID NO: 6319 - DNA, 411 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtccaaaaccaggagatgggcagaaaatatacgagctactttcgctcattttgaattaaggtcctttcgtcatgcaaatttggggaacatcaaagagacaaagactaggaccactattcttacagttcccctcatggtctgagaatatgctggga

SEQ ID NO: 6320 - DNA, 422 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgcctaccgctgctttcgctcattttgaattaaggtcctttcatcatgcaaattttggggaacatcaaagagacaaagactagggaccaccatttcatacagatcccctcgtggtctgagaatatgctggga

SEQ ID NO: 6321 - DNA, 428 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggccatcttgactaccggtaatgcctaccgctgctttcgctcattttgaattaaggtcctttcatcatgcaaatttggggaaacatcaaagagacaaagactagggaccaccatttcatacagatcccctgtggtctgagaatatgctggga

SEQ ID NO: 6322 - DNA, 464 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgaaagccatcttgactaccggtaatgcctaccgctaattcgctcattttgaattaaggtcctttcatcatgcaaatttggggaacatcaaagaggcaaagactagggaccactatttcatacagttcccctcatggtctgagaatatgctggga

SEQ ID NO: 6323 - DNA, 409 bp, Artificial
  TaSBEIIa  allele with mutations introduced by TALEN pair TaSBEIIa_T01
tcagatggatgtgcactctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatctgctttcgctcattttgaattaaggtcctttcatcatgcaaatttggggaacatcaaagagacaaagactagggaccaccatttcatacagatcccctcgtggtctgagaatatgctggga

SEQ ID NO: 6324 - DNA, 405 bp, Artificial
  TaSBEIIa  allele with mutations introduced by TALEN pair TaSBEIIa_T01
  misc_feature (383): n is a or c or t or g
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgacattttgaattaaggtcctttcatcatgcaaatttggggaacatcaaagaggcaaagactagggaccactatttcatacagttcccctnatggtctgagaatatgctggga

SEQ ID NO: 6325 - DNA, 429 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacctacccgctgctttcgctcattttgaattaaggtcctttcatcatgcaaatttggggaacatcaaagagacaaagacctagggacaccatttcatacagatcccctcgtggtctgagaaaatgctggga

SEQ ID NO: 6326 - DNA, 454 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6327 - DNA, 448 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctaccgctactttcgctcattttgaattaaggtcctttcgtcatgcaaatttggggaacatcaaagagacaaagactagggaccactatttcttacagttcccctcatgtctgagaatatgctggga

SEQ ID NO: 6328 - DNA, 446 bp, Artificial
  TaSBEIIa  allele with mutations introduced by TALEN pair TaSBEIIa_T01
tcagatggatgtgcattctagcaagaacttcacgaaataatgcactgtttgtggtttcgtttgtctgctctacgattgctatttttcgtgtgctgtagatacctgaagatatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 6329 - DNA, 448 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6330 - DNA, 422 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagtaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6331 - DNA, 380 bp, Artificial; identical to SEQ ID NO: 6194
  TaSBEIIa  allele with mutations introduced by TALEN pair TaSBEIIa_T01

SEQ ID NO: 6332 - DNA, 461 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaaccaggagatgggcagaaaatatacgagattgacccaacgctcggagccatcttgactaccggtaatgcctacccgctactttcgctcatttgaattaaggtccttcgtcatgcaaatttggggaacatcaaagagacaaagactagggaccactattcttacagttcccctcatggtctgagaatatgctggga

SEQ ID NO: 6333 - DNA, 463 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaaagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6334 - DNA, 449 bp, Artificial; identical to SEQ ID NO: 6275
  TaSBEIIa  allele with mutations introduced by TALEN pair TaSBEIIa_T01

SEQ ID NO: 6335 - DNA, 466 bp, Artificial; identical to SEQ ID NO: 6299
  TaSBEIIa  allele with mutations introduced by TALEN pair TaSBEIIa_T01

SEQ ID NO: 6336 - DNA, 414 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatacccgctactttcgctcattttgaattaaggtcctttcgtcatgcaaatttggggaacatcaaagagacaaagactagggaccactatttcttacagttcccctcatggtctgagaatatgctgggga

SEQ ID NO: 6337 - DNA, 430 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctaatttcgctcattttgaattaaggtcctttcatcatgcaaatttggggaacatcaaagaggcaaagactagggaccactatttcatacagttcccctcatggtctgagaatatgctggga

SEQ ID NO: 6338 - DNA, 364 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgctcattttgaattaaggtcctttcgtcatgcaaatttggggaacatcaaagagacaaagactagggaccactatttcttacagttccctcatggtctgagaatatgctggga

SEQ ID NO: 6339 - DNA, 416 bp, Artificial; identical to SEQ ID NO: 6131
  TaSBEIIa  allele with mutations introduced by TALEN pair TaSBEIIa_T01

SEQ ID NO: 6340 - DNA, 454 bp, Artificial
  TaSBEIIa  allele with mutations introduced by TALEN pair TaSBEIIa_T01
tcagtggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6341 - DNA, 477 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctaccggtaatgcctacccgctaatttcgctcattttgaattaaggtcctttcatcatgcaaatttgggaacatcaaagaggcaaagactagggaccactatttcatacagttcccctcatggtctgagatatgctgggactgagacgcacgagcacagggaggtagag

SEQ ID NO: 6342 - DNA, 447 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaactgactaccggtaatgcctacccgctactttcgctcattttgaattaaggtcctttcgtcatgcaaatttgggaacatcaaagagacaaagactagggaccactatttcttacagttccctcatggtctgagaatatgctggga

SEQ ID NO: 6343 - DNA, 450 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6344 - DNA, 441 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagtcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6345 - DNA, 464 bp, Artificial
  TaSBEIIa  allele with mutations introduced by TALEN pair TaSBEIIa_T01
  misc_feature (443): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgaaagccatcttgactaccggtaatgcctacccgctaatttcgctcattttgaattaaggtcctttcatcatgcaaatttggggaacatcaaagaggcaaagactagggaccactatttcatacagttccccnatggtctgagatatgctggga

SEQ ID NO: 6346 - DNA, 427 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6347 - DNA, 339 bp, Artificial; identical to SEQ ID NO: 6123
  TaSBEIIa  allele with mutations introduced by TALEN pair TaSBEIIa_T01

SEQ ID NO: 6348 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaagattttcggagccatcttgactaccggtaatgcctacccgctgctttcgctcattttgaattaaggtcctttcatcatgcaaatttggggaacatcaaagagacaaagactagggaccaccatttcatacagactcccctcgtggtctgagaatatgctggga

SEQ ID NO: 6349 - DNA, 447 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaaagataatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 6350 - DNA, 438 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6351 - DNA, 445 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 6352 - DNA, 463 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 6353 - DNA, 450 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 6354 - DNA, 428 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcaggactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6355 - DNA, 392 bp, Artificial
  TaSBEIIa  allele with mutations introduced by TALEN pair TaSBEIIa_T01
tcagatggatgtgcattctagcaagaacttcacgaaataatgcactgtttgtagtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagactttcgctcatttgaattaaggtcctttcgtcatgcaaatttggggaacatcaaagagacaaagactagggaccactatttcttacagttcccctcatggtctgagaatatgctggga

SEQ ID NO: 6356 - DNA, 340 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaatcatcatgcaaatttggggaacatcaaagagacaaagactagggaccaccatttcatacagatcccctcgtggtctgagaatatgctggga

SEQ ID NO: 6357 - DNA, 265 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcggggagcaaacggctgaagtaaacatgacagggggactgcagaaaaacttgaatcttcagaaccgactcaaggcaatttggggaacatcaaagagacaaagactagggaccactatttcttacagttcccctcatggtctgagaatatgctggga

SEQ ID NO: 6358 - DNA, 409 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatctccagaaccgactcagggcattgtggaaacaatcactgatggtgtaaccaaaggagttaaggaactagtcgtgggggagaaaccgcgagttgtcccaaaaccaggagatgggcagacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6359 - DNA, 457 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6360 - DNA, 439 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatataatcttgactaccggtaatgcctacccgctacttttcgctcattttgaattaaggtcctttcgtcatgcaaatttggggaacatcaaagagacaaagactagggaccactatttcttacagttcccctcatggtctgagaatatgctggga

SEQ ID NO: 6361 - DNA, 453 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaaccaggagatgggcagaaaatatacgagatttttcggagccatcttgactaccggtaatgcctaccgctgctttcgctcattttgaattaaggtcctttcatcatgcaaatttgggaacatcaaagagacaaagactagggaccaccatttcatacagatccctcgtggtctgagaatatgctggga

SEQ ID NO: 6362 - DNA, 447 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6363 - DNA, 451 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcatcttgactaccggtaatgcctaccgctactttcgctcattttgaattaaggtcctttcgcatgcaaatttggggaacatcaaagagacaaagactagggaccactattctacagttcccctcatggtctgagaatatgctggga

SEQ ID NO: 6364 - DNA, 435 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtggggagaaaccgcgagttgtcccaaaaccaggagatgggcagaaaatatacgagctaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6365 - DNA, 336 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagacatgcaaatttggggaacatcaaagaggcaaagactagggaccactatttcatacagttcccctcatggtctgagaatatgctggga

SEQ ID NO: 6366 - DNA, 438 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttgactaccggtaatgcctacccgctgctttcgctcattttgaattaaggtccttcatcatgcaaattggggaacatcaaagagacaaagactagggaccaccatttcatacagatcccctcgtggtctgagatatgctggga

SEQ ID NO: 6367 - DNA, 437 bp, Artificial; identical to SEQ ID NO: 6168
  TaSBEIIa  allele with mutations introduced by TALEN pair TaSBEIIa_T01

SEQ ID NO: 6368 - DNA, 367 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttggggaacatcaaaagagacaaagactagggaccactatttcttacagttcccctcatggtctgagaatatgctggga

SEQ ID NO: 6369 - DNA, 369 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttcattttgaattaaggtcctttcatcatgcaaatttggggaacatcaaagagacaaagactagggaccaccatttcatacagatcccctcgtggtctgagaatatgctggga

SEQ ID NO: 6370 - DNA, 449 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6371 - DNA, 451 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6372 - DNA, 451 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6373 - DNA, 420 bp, Artificial; identical to SEQ ID NO: 6213
  TaSBEIIa  allele with mutations introduced by TALEN pair TaSBEIIa_T01

SEQ ID NO: 6374 - DNA, 339 bp, Artificial; identical to SEQ ID NO: 6123
  TaSBEIIa  allele with mutations introduced by TALEN pair TaSBEIIa_T01

SEQ ID NO: 6375 - DNA, 418 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagataatttcgctcattttgaattaaggtcctttcatcatgcaaatttggggaacatcaaagaggcaaagactagggaccactatttcatacagttcccctcatggtctgagaatatgctggga

SEQ ID NO: 6376 - DNA, 393 bp, Artificial; identical to SEQ ID NO: 6210
  TaSBEIIa  allele with mutations introduced by TALEN pair TaSBEIIa_T01

SEQ ID NO: 6377 - DNA, 464 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgaaagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6378 - DNA, 367 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttggggaacatcaaagagacaaagactaagggaccactatttcttacagttcccctcatggtctgagaatatgctggga

SEQ ID NO: 6379 - DNA, 430 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaataccggtaatgcctacccgctaatttcgctcattttgaattaaggtcctttcatcatgcaaatttggggaacatcaaagaggcaaaagactagggaccactatttcatacagttcccctcatggtctgagaatatgctggga

SEQ ID NO: 6380 - DNA, 456 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6381 - DNA, 456 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcatcttgactaccggtaatgcctacccgctacttttcgctcattttgaattaaggtcctttcgtcatgcaaatttggggaacatcaaagagacaaagactagggaccactatttcttacagttcccctcatggtctgagaatatgctggga

SEQ ID NO: 6382 - DNA, 376 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaaattaaggtcctttcatcatgcaaatttggggaacatcaaagaggcaaagactagggaccactatttcatacagttcccctcatggtctgagaatatgctggga

SEQ ID NO: 6383 - DNA, 380 bp, Artificial; identical to SEQ ID NO: 6215
  TaSBEIIa  allele with mutations introduced by TALEN pair TaSBEIIa_T01

SEQ ID NO: 6384 - DNA, 446 bp, Artificial; identical to SEQ ID NO: 6227
  TaSBEIIa  allele with mutations introduced by TALEN pair TaSBEIIa_T01

SEQ ID NO: 6385 - DNA, 445 bp, Artificial; identical to SEQ ID NO: 6267
  TaSBEIIa  allele with mutations introduced by TALEN pair TaSBEIIa_T01

SEQ ID NO: 6386 - DNA, 453 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgaccccatcttgactaccggtaatgcctacccgctaatttcgctcattttgaattaaggtcctttcatcatgcaaatttggggaacatcaaagaggcaaagactagggaccactatttcatacagttcccctcatggtctgagatatgctggga

SEQ ID NO: 6387 - DNA, 354 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactgctttcgctcattttgaattaaggtcctttcatcatgcaaatttggggaacatcaaagagacaaagactagggaccaccatttcatacagatcccctcgtggtctgagaatattgctggga

SEQ ID NO: 6388 - DNA, 366 bp, Artificial; identical to SEQ ID NO: 6175
  TaSBEIIa  allele with mutations introduced by TALEN pair TaSBEIIa_T01

SEQ ID NO: 6389 - DNA, 428 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgcatcttgactaccggtaatgcctacccgctgcttttcgctcattttgaattaaggtcctttcatcatgcaaatttggggaacatcaaagagacaaagactagggaccaccatttcatacagatcccctcgtggtctgagaatatgctggga

SEQ ID NO: 6390 - DNA, 317 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactaatttggggaacatcaaagaggcaaaagactagggaccactatttcatacagttcccctcatggtctgagaatatgctggga

SEQ ID NO: 6391 - DNA, 428 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccctacccgctactttcgctcattttgaattaaggtcctttcgtcatgcaaatttggggaacatcaaagagacaaagactagggaccactatttcttacagttcccctcatggtctgagatatgctggga

SEQ ID NO: 6392 - DNA, 376 bp, Artificial; identical to SEQ ID NO: 6382
  TaSBEIIa  allele with mutations introduced by TALEN pair TaSBEIIa_T01

SEQ ID NO: 6393 - DNA, 448 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 6394 - DNA, 429 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcggtgggggagaaaccgcgagttgtcccaaaaccaggagatggccatcttgactaccggtaatgcctacccgctgctttcgctcattttgaattaaggtcctttcatcatgcaaatttggggaacatcaaagagacaaagactagggacaccatttcatacagatcccctcgtggtctgagaatatgctggga

SEQ ID NO: 6395 - DNA, 440 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctactttcgctcattttgaattaaggtcctttcgtcatgcaaatttggggaacatcaaagagacaaagactagggaccactattctacagttccctcatggtctgagaatatgctggga

SEQ ID NO: 6396 - DNA, 379 bp, Artificial; identical to SEQ ID NO: 6183
  TaSBEIIa  allele with mutations introduced by TALEN pair TaSBEIIa_T01

SEQ ID NO: 6397 - DNA, 344 bp, Artificial; identical to SEQ ID NO: 6216
  TaSBEIIa  allele with mutations introduced by TALEN pair TaSBEIIa_T01

SEQ ID NO: 6398 - DNA, 452 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctaccgctgcttttcgctcattttgaattaaggtcctttcatcatgcaaatttgggaacatcaaagagacaaagactaggaccaccatttcatacagatcccctgtggtctgagaatatgctggga

SEQ ID NO: 6399 - DNA, 393 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagactttcgctcattttgaattaaggtcctttcgtcatgcaaattttggggaacatcaaagagacaaagactagggaccactatttctacagttcccctcatggtctgagaatatgctggga

SEQ ID NO: 6400 - DNA, 400 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggctgctttcgctcattttgaattaaggtcctttcatcatgcaaatttggggaacatcaaagagacaaagactaggaccaccatttcatacagatcccctcgtggtctgagaatatgctggga

SEQ ID NO: 6401 - DNA, 403 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatttcgctcattttgaattaaggtcctttcgtcatgcaaatttggggaacatcaaagagacaaagactagggaccactattcttacagttcccctcatggtctgagatatgctggga

SEQ ID NO: 6402 - DNA, 403 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgcccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6403 - DNA, 451 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6404 - DNA, 441 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgactaccggtaatgcctacccgctactttcgctcattttgaattaaggtcctttcgtcatgcaaatttggggaaacatcaaagagacaaagactagggaccactatttcttacagttcccctcatggtctgagaatatgctggga

SEQ ID NO: 6405 - DNA, 453 bp, Artificial
  TaSBEIIa  allele with mutations introduced by TALEN pair TaSBEIIa_T01
  misc_feature (431): n is a or c or t or g
tcagatggatgtgcattctagcaagaacttcacgaaataatgcactgtttgtggtttcgttagtctgctctacaattgctattttcgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaaccaggagatgggcaagaaaatatacgagatttcggagccatcttgactaccggtaatgcctaccgctaatttcgctcattttgaattaaggtcctttcatcatgcaaatttgggaacatcaaagaggcaaagactagggaccactatttcatacagttcccctnatggtctgagaatatgctggga

SEQ ID NO: 6406 - DNA, 422 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 6407 - DNA, 448 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattcatcttgactaccggtaatgcctacccgctgctttcgctcattttgaattaaggtcctttcatcatgcaaatttggggaacatcaaaagagacaaagactagggaccaccatttcatacagatcccctcgtggtctgagaatatgctggga

SEQ ID NO: 6408 - DNA, 263 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcggggagcaaacggctgaagtaacatgacagggggactgcagaaaacttgaatcttcagaaccgactcaaggcaatttggggaacatcaaagagacaaagactagggaccactatttcttacagttcccctcatggtctgagaatatgctggga

SEQ ID NO: 6409 - DNA, 392 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagactttcgctcattttgaattaaggtcctttcgtcatgcaaatttgggaacatcaaagagacaaagactagggaccactatttcttacagttcccctcatggtctgagaatatgctggga

SEQ ID NO: 6410 - DNA, 440 bp, Artificial; identical to SEQ ID NO: 6178
  TaSBEIIa  allele with mutations introduced by TALEN pair TaSBEIIa_T01

SEQ ID NO: 6411 - DNA, 402 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggctgctttcgctcattttgaattaaggtccttttcatcatgcaaatttggggaacatcaaagagacaaagactagggaccaccatttcatacagatcccctcgtggtctgagaatatgctggga

SEQ ID NO: 6412 - DNA, 429 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctaatttcgctcattttgaattaaggtcctttcatcatgcaaatttggggaacatcaaagaggcaaagactagggaccactatttcatacagttcccctcatggtctgagaatatgctggga

SEQ ID NO: 6413 - DNA, 454 bp, Artificial
  TaSBEIIa  allele with mutations introduced by TALEN pair TaSBEIIa_T01
tcagatggatgtgcattctagcaagaacttcacaacataatgcatcgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6414 - DNA, 446 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagatccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6415 - DNA, 439 bp, Artificial; identical to SEQ ID NO: 6214
  TaSBEIIa  allele with mutations introduced by TALEN pair TaSBEIIa_T01

SEQ ID NO: 6416 - DNA, 430 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccctacccgctactttcgctcattttgaattaaggtcctttcgtcatgcaaattttggggaacatcaaagagacaaagactagggaccactatttcttacagttcccctcatggtctgagaatatgctggga

SEQ ID NO: 6417 - DNA, 339 bp, Artificial; identical to SEQ ID NO: 6123
  TaSBEIIa  allele with mutations introduced by TALEN pair TaSBEIIa_T01

SEQ ID NO: 6418 - DNA, 415 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaacaggagatgggcagaaaaatacccgctactttcgctcattttgaattaaggtcctttcgtcatgcaaatttggggaacatcaaagagacaaagactagggaccactatttcttacagttcccctcatggtctgagaatatgctgggga

SEQ ID NO: 6419 - DNA, 459 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6420 - DNA, 453 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcaagaaaatatacgagattgacccatcttgactaccggtaatgcctacccgctgcttttcgctcattttgaattaaggtcctttcatcatgcaaatttggggaacatcaaagagacaaagactagggaccaccatttcatacagatcccctcgtggtctgagaatatgctggga

SEQ ID NO: 6421 - DNA, 487 bp, Artificial
  TaSBEIIa  allele with mutations introduced by TALEN pair TaSBEIIa_T01
tcagatggagtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggggactagactactcgacgacgcaacacgggaggtagagg

SEQ ID NO: 6422 - DNA, 405 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatttcgctcattttgaattaaggtcctttcgtcatgcaaatttggggaacatcaaagagacaaagactagggaccactatttcttacagttcccctcatggtctgagaatatgctggga

SEQ ID NO: 6423 - DNA, 379 bp, Artificial; identical to SEQ ID NO: 6183
  TaSBEIIa  allele with mutations introduced by TALEN pair TaSBEIIa_T01

SEQ ID NO: 6424 - DNA, 438 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgactaccggtaatgcctacccgctactttcgctcattttgaattaaggtcctttcgtcatgcaaatttggggaacatcaaagagacaaagactagggaccactatttctacagttcccctcatggtctgagatatgctggga

SEQ ID NO: 6425 - DNA, 466 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttcggagccatcttgactaccggtaatgcctacccgctgctttcgctcattttgaattaaggtcctttcatcatgcaaatttggggaacatcaaagagacaaagactagggaccaccatttcatacagactcccctcgtggtctgagaatatgctggga

SEQ ID NO: 6426 - DNA, 430 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagccatcttgactaccggtaatgcctaccgctgctttcgctcattttgaattaaggtcctttcatcatgcaaatttgggaacatcaaagagacaaagactagggaccaccatttcatacagatcccctgtggtctgagaatatgctggga

SEQ ID NO: 6427 - DNA, 437 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6428 - DNA, 443 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctgctttcgctcattttgaattaaggtcctttcatcatgcaaatttgggaacatcaaagagacaaagactagggaccaccatttcatacagatcccctgtggtctgagaatatgctggga

SEQ ID NO: 6429 - DNA, 451 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattcggagccatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 6430 - DNA, 316 bp, Artificial; identical to SEQ ID NO: 6184
  TaSBEIIa  allele with mutations introduced by TALEN pair TaSBEIIa_T01

SEQ ID NO: 6431 - DNA, 398 bp, Artificial
  TaSBEIIa  allele with mutations introduced by TALEN pair TaSBEIIa_T01
  misc_feature (376): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgatttcgctcattttgaattaaggtcctttcatcatgcaaatttggggaacatcaaagaggcaaagactagggaccactatttcatacagttcccctnatggtctgagaatatgctggga

SEQ ID NO: 6432 - DNA, 453 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6433 - DNA, 365 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttggggaacatcaaagagacaaagactagggaccactattcttacagttcccctcatggtctgagaatatgctggga

SEQ ID NO: 6434 - DNA, 378 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtcctttcgctcattttgaattaaggtcctttcgtcatgcaaatttggggaacatcaaagagacaaagactagggaccactatttcttacagttcccctcatggtctgagaatatgctggga

SEQ ID NO: 6435 - DNA, 394 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagactttcgctcattttgaattaaggtcctttcgtcatgcaaattttggggaacatcaaagagacaaagactagggaccactatttcttacagttcccctcatggtctgagaatatgctggga

SEQ ID NO: 6436 - DNA, 454 bp, Artificial; identical to SEQ ID NO: 6244
  TaSBEIIa  allele with mutations introduced by TALEN pair TaSBEIIa_T01

SEQ ID NO: 6437 - DNA, 447 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattcatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6438 - DNA, 456 bp, Artificial; identical to SEQ ID NO: 6142
  TaSBEIIa  allele with mutations introduced by TALEN pair TaSBEIIa_T01

SEQ ID NO: 6439 - DNA, 440 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagtcggagccatcttgactaccggtaatgcctaccgctaatttcgctcattttgaattaaggtcctttcatcatgcaaatttggggaacatcaaagaggcaaagactagggaccactatttcatacagttcccctcatggtctgagaatatgctggga

SEQ ID NO: 6440 - DNA, 379 bp, Artificial; identical to SEQ ID NO: 6183
  TaSBEIIa  allele with mutations introduced by TALEN pair TaSBEIIa_T01

SEQ ID NO: 6441 - DNA, 351 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagtcctttcgtcatgcaaatttggggaacatcaaagagacaaagactagggaccactatttcttacagttcccctcatggtctgagaatatgctggga

SEQ ID NO: 6442 - DNA, 397 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgatttcgctcattttgaattaaggtcctttcatcatgcaaatttggggaacatcaaagaggcaaagactagggaccactatttcatacagttccctcatggtctgagaatatgctggga

SEQ ID NO: 6443 - DNA, 366 bp, Artificial; identical to SEQ ID NO: 6175
  TaSBEIIa  allele with mutations introduced by TALEN pair TaSBEIIa_T01

SEQ ID NO: 6444 - DNA, 429 bp, Artificial; identical to SEQ ID NO: 6160
  TaSBEIIa  allele with mutations introduced by TALEN pair TaSBEIIa_T01

SEQ ID NO: 6445 - DNA, 450 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgcaccggtaatgcctacccgctaatttcgctcattttgaattaaggtcctttcatcatgcaaatttggggaacatcaaagaggacaaagactagggaccactatttcatacagttcccctcatggtctgagaatatgctggga

SEQ ID NO: 6446 - DNA, 452 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctgga

SEQ ID NO: 6447 - DNA, 455 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6448 - DNA, 381 bp, Artificial; identical to SEQ ID NO: 6169
  TaSBEIIa  allele with mutations introduced by TALEN pair TaSBEIIa_T01

SEQ ID NO: 6449 - DNA, 393 bp, Artificial; identical to SEQ ID NO: 6210
  TaSBEIIa  allele with mutations introduced by TALEN pair TaSBEIIa_T01

SEQ ID NO: 6450 - DNA, 403 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagctttcgctcattttgaattaaggtcctttcatcatgcaaatttggggaacatcaaagagacaaagactagggaccaccatttcatacagatcccctcgtggtctgagaatatggactggga

SEQ ID NO: 6451 - DNA, 344 bp, Artificial; identical to SEQ ID NO: 6216
  TaSBEIIa  allele with mutations introduced by TALEN pair TaSBEIIa_T01

SEQ ID NO: 6452 - DNA, 400 bp, Artificial; identical to SEQ ID NO: 6205
  TaSBEIIa  allele with mutations introduced by TALEN pair TaSBEIIa_T01

SEQ ID NO: 6453 - DNA, 452 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttcggagccatcttgactaccggtaatgcctacccgctgctttcgctcattttgaattaaggtcctttcatcatgcaaatttgggaacatcaaagagacaaagactaggaccaccatttcatacagatcccctcgtggtctgagaatatgctggga

SEQ ID NO: 6454 - DNA, 409 bp, Artificial; identical to SEQ ID NO: 6358
  TaSBEIIa  allele with mutations introduced by TALEN pair TaSBEIIa_T01

SEQ ID NO: 6455 - DNA, 462 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgcggagccatcttgactaccggtaatgcctaccgctaatttcgctcattttgaattaaggtcctttcatcatgcaaatttggggaacatcaaagaggcaaagactagggaccactattcatacagttcccctcatggtctgagaatatgctggga

SEQ ID NO: 6456 - DNA, 315 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggaacatcaaagagacaaagactagggaccactatttcttacagttcccctcatggtctgagaatatgctggga

SEQ ID NO: 6457 - DNA, 446 bp, Artificial
  TaSBEIIa  allele with mutations introduced by TALEN pair TaSBEIIa_T01
tcagatgatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6458 - DNA, 429 bp, Artificial; identical to SEQ ID NO: 6160
  TaSBEIIa  allele with mutations introduced by TALEN pair TaSBEIIa_T01

SEQ ID NO: 6459 - DNA, 409 bp, Artificial; identical to SEQ ID NO: 6358
  TaSBEIIa  allele with mutations introduced by TALEN pair TaSBEIIa_T01

SEQ ID NO: 6460 - DNA, 409 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatctgctttcgctcattttgaattaaggtcctttcatcatgcaaatttggggaacatcaaagagacaaagactagggaccaccatttcatacagatcccctcgtggtctgagaatatgctggga

SEQ ID NO: 6461 - DNA, 441 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttgactaccggtaatgcctacccgctgctttcgctcattttgaattaaggtcctttcatcatgcaaatttggggaacatcaaagagacaaagactagggaccaccatttcatacagatcccctcgtgtctgagaatatgctggga

SEQ ID NO: 6462 - DNA, 450 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6463 - DNA, 449 bp, Artificial
  TaSBEIIa  allele with mutations introduced by TALEN pair TaSBEIIa_T01
  misc_feature (329): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgttgactaccggtaatgcctaccgntactttcgctcattttgaattaaggtcctttcgtcatgcaaatttggggaacatcaaagagacaaagactagggaccactatttctacagttcccctcatggtctgagaatatgctggga

SEQ ID NO: 6464 - DNA, 364 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttggggaacatcaaagagacaaagactagggaccactatttctacagttccctcatggtctgagaatatgctggga

SEQ ID NO: 6465 - DNA, 413 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatacccgctactttcgctcattttgaattaaggtcctttcgtcatgcaaatttggggaacatcaaagagacaaagactagggaccactatttcttacagttcccctcatggtctgagaatatgctggga

SEQ ID NO: 6466 - DNA, 398 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgatttcgctcattttgaattaaggtcctttcatcatgcaaatttggggaacatcaaagaggcaaagactagggaccactatttcatacagttcccctcatggtctgagaatatgctggga

SEQ ID NO: 6467 - DNA, 444 bp, Artificial
  TaSBEIIa  allele with mutations introduced by TALEN pair TaSBEIIa_T01
  misc_feature (383): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctgctttcgctcattttgaattaaggtcctttcatcatgcaaatttgggaacatcaaagngacaaagactagggaccaccatttcatacagatcccctgtggtctagagaatatgctggga

SEQ ID NO: 6468 - DNA, 339 bp, Artificial; identical to SEQ ID NO: 6123
  TaSBEIIa  allele with mutations introduced by TALEN pair TaSBEIIa_T01

SEQ ID NO: 6469 - DNA, 387 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtggggagaaaccgcgagttgcctacccgctgctttcgctcattttgaattaaggtcctttcatcatgcaaatttggggaacatcaaagagacaaagactagggaccaccatttcatacagatcccctcgtgtctgagaatatgctggga

SEQ ID NO: 6470 - DNA, 456 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccatcttgactaccggtaatgcctacccgctactttcgctcattttgaatttaaggtcctttcgtcatgcaaatttggggaacatcaaagagacaaagactagggaccactattcttacagttcccctcatggtctgagaatatgctggga

SEQ ID NO: 6471 - DNA, 338 bp, Artificial
  TaSBEIIa  allele with mutations introduced by TALEN pair TaSBEIIa_T01
tcagatggatgtgcattctagcaagaactcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagtcaaatttggggaacatcaaagagacaaagactagggaccactatttcttacagttcccctcatggtctgagaatatgctggga

SEQ ID NO: 6472 - DNA, 450 bp, Artificial; identical to SEQ ID NO: 6462
  TaSBEIIa  allele with mutations introduced by TALEN pair TaSBEIIa_T01

SEQ ID NO: 6473 - DNA, 436 bp, Artificial; identical to SEQ ID NO: 6302
  TaSBEIIa  allele with mutations introduced by TALEN pair TaSBEIIa_T01

SEQ ID NO: 6474 - DNA, 440 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6475 - DNA, 455 bp, Artificial; identical to SEQ ID NO: 6447
  TaSBEIIa  allele with mutations introduced by TALEN pair TaSBEIIa_T01

SEQ ID NO: 6476 - DNA, 380 bp, Artificial; identical to SEQ ID NO: 6194
  TaSBEIIa  allele with mutations introduced by TALEN pair TaSBEIIa_T01

SEQ ID NO: 6477 - DNA, 439 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatataatcttgactaccggtaatgcctacccgctactttcgctcattttgaattaaggtcctttcgtcatgcaaagtttggggaacatcaaagagaacaaagactagggaccactatttctacagttcccctcatggtctgagaatatgctggga

SEQ ID NO: 6478 - DNA, 456 bp, Artificial; identical to SEQ ID NO: 6380
  TaSBEIIa  allele with mutations introduced by TALEN pair TaSBEIIa_T01

SEQ ID NO: 6479 - DNA, 446 bp, Artificial; identical to SEQ ID NO: 6414
  TaSBEIIa  allele with mutations introduced by TALEN pair TaSBEIIa_T01

SEQ ID NO: 6480 - DNA, 465 bp, Artificial; identical to SEQ ID NO: 6208
  TaSBEIIa  allele with mutations introduced by TALEN pair TaSBEIIa_T01

SEQ ID NO: 6481 - DNA, 366 bp, Artificial; identical to SEQ ID NO: 6175
  TaSBEIIa  allele with mutations introduced by TALEN pair TaSBEIIa_T01

SEQ ID NO: 6482 - DNA, 424 bp, Artificial; identical to SEQ ID NO: 6190
  TaSBEIIa  allele with mutations introduced by TALEN pair TaSBEIIa_T01

SEQ ID NO: 6483 - DNA, 445 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagatttgactaccggtaatgcctacccgctaatttcgctcattttgaattaaggtcctttcatcatgcaaatttggggaacatcaaagaggcaaagactagggaccactatttcatacagttccccctcatggtctgagaatatgctggga

SEQ ID NO: 6484 - DNA, 452 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcatcttgactaccggtaatgcctaccgctactttcgctcattttgaattaaggtcctttcgtcatgcaaatttggggaacatcaaagagacaaagactagggaccactattcttacagttcccctcatggtctgagatatgctggga

SEQ ID NO: 6485 - DNA, 369 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttcattttgaattaaggtcctttcatcatgcaaatttgggaacatcaaaagagacaaagactagggaccaccatttcatacagatcccctcgtggtctgagaatatgctggga

SEQ ID NO: 6486 - DNA, 440 bp, Artificial; identical to SEQ ID NO: 6439
  TaSBEIIa  allele with mutations introduced by TALEN pair TaSBEIIa_T01

SEQ ID NO: 6487 - DNA, 424 bp, Artificial; identical to SEQ ID NO: 6190
  TaSBEIIa  allele with mutations introduced by TALEN pair TaSBEIIa_T01

SEQ ID NO: 6488 - DNA, 363 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttgggaacatcaaagagacaaagactagggaccactattcttacagttccctcatggtctgagaatatgctggga

SEQ ID NO: 6489 - DNA, 456 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccggagccatcttgactaccggtaatgcctaccgctgctttcgctcattttgaatttaaggtcctttcatcatgcaaatttgggaacatcaaagagacaaagactagggaccaccatttcatacagatcccctcgtggtctgagaatatgctggga

SEQ ID NO: 6490 - DNA, 451 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccatcttgactaccggtaatgcctaccgctaatttcgctcattttgaattaaggtcctttcatcatgcaaatttggggaacatcaaagaggcaaagactagggaccactattcatacagttcccctcatggtctgagaatatgctggga

SEQ ID NO: 6491 - DNA, 338 bp, Artificial; identical to SEQ ID NO: 6239
  TaSBEIIa  allele with mutations introduced by TALEN pair TaSBEIIa_T01

SEQ ID NO: 6492 - DNA, 366 bp, Artificial; identical to SEQ ID NO: 6175
  TaSBEIIa  allele with mutations introduced by TALEN pair TaSBEIIa_T01

SEQ ID NO: 6493 - DNA, 438 bp, Artificial
  TaSBEIIa  allele with mutations introduced by TALEN pair TaSBEIIa_T01
  misc_feature (416): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcaagaaaatataatcttgactaccggtaatgcctacccgctactttcgctcattttgaattaaggtcctttcgtcatgcaaatttggggaacatcaaagagacaaagactagggaccactatttctacagttcccctnatggtctgagaatatgctggga

SEQ ID NO: 6494 - DNA, 366 bp, Artificial; identical to SEQ ID NO: 6175
  TaSBEIIa  allele with mutations introduced by TALEN pair TaSBEIIa_T01

SEQ ID NO: 6495 - DNA, 424 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 6496 - DNA, 397 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgatttcgctcattttgaattaaggtcctttcatcatgcaaatttggggacatcaaagaggcaaagactagggaccactatttcatacagttcccctcatggtctgagaatatgctggga

SEQ ID NO: 6497 - DNA, 428 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaataccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 6498 - DNA, 442 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6499 - DNA, 382 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgaattaaggtcctttcgtcatgcaaaattttggggaacatcaaagagacaaagactagggaccactatttcttacagttcccctcatggtctgagaatatgctggga

SEQ ID NO: 6500 - DNA, 381 bp, Artificial; identical to SEQ ID NO: 6169
  TaSBEIIa  allele with mutations introduced by TALEN pair TaSBEIIa_T01

SEQ ID NO: 6501 - DNA, 456 bp, Artificial
  TaSBEIIa  allele with mutations introduced by TALEN pair TaSBEIIa_T01
tcagatggatgtgcattctagcaagaacttcacaacataatgcatcgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6502 - DNA, 428 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 6503 - DNA, 416 bp, Artificial; identical to SEQ ID NO: 6131
  TaSBEIIa  allele with mutations introduced by TALEN pair TaSBEIIa_T01

SEQ ID NO: 6504 - DNA, 416 bp, Artificial; identical to SEQ ID NO: 6131
  TaSBEIIa  allele with mutations introduced by TALEN pair TaSBEIIa_T01

SEQ ID NO: 6505 - DNA, 415 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagtttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6506 - DNA, 343 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaacctttcatcatgcaaatttggggaacatcaaagagacaaagactagggaccaccatttcatacagatccctcgtggtctgagaatatgctggga

SEQ ID NO: 6507 - DNA, 448 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaactaccggtaatgcctacccgctaatttcgctcattttgaattaaggtcctttcatcatgcaaattttggggaacatcaaagaggcaaagactagggaccactattcatacagttcccctcatggtctgagaatatgctggga

SEQ ID NO: 6508 - DNA, 436 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacgaggggggaccgcagagaaacttgaatcttcagaaccgactcagggcattgtggaaacaatcactgatggtgtaaccaaaggagttaaggaactagtcggcgggggagaaaccgcgagttgtaccccaaaaccaggagatgggcaagaaaatatacgagattgacccaacgctaatttcgctcattttgaattaaggtcctttcatcatgcaaatttggggaacatcaaagaggacaaagactagggaccactatttcatacagttcccctcatggtctgagaatatgctggga

SEQ ID NO: 6509 - DNA, 426 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggttgactaccggtaatgcctacccgctactttcgctcattttgaattaaggtcctttcgtcatgcaaattttggggaacatcaaagagacaaagactagggaccactatttcttaacagttcccctcatgggtctgagaatatgctggga

SEQ ID NO: 6510 - DNA, 455 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6511 - DNA, 379 bp, Artificial; identical to SEQ ID NO: 6183
  TaSBEIIa  allele with mutations introduced by TALEN pair TaSBEIIa_T01

SEQ ID NO: 6512 - DNA, 344 bp, Artificial; identical to SEQ ID NO: 6216
  TaSBEIIa  allele with mutations introduced by TALEN pair TaSBEIIa_T01

SEQ ID NO: 6513 - DNA, 450 bp, Artificial
  TaSBEIIa  allele with mutations introduced by TALEN pair TaSBEIIa_T01
  misc_feature (427); (437): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacatcttgactaccggtaatgcctacccgctactttcgctcattttgaattaaggtcctttcgtcatgcaaatttggggaacatcaaagagacaaagactagggaccactatttcttacagttccccctnatggtctganaatatgcgtggga

SEQ ID NO: 6514 - DNA, 455 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 6515 - DNA, 438 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatcttgactaccggtaatgcctacccgctaatttcgctcattttgaattaaggtcctttcatcatgcaaatttggggaacatcaaagaggcaaagactagggaccactaatttcatacagttcccctcatggtctgagaatatgctggg

SEQ ID NO: 6516 - DNA, 396 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtccccaaaaaccaggagacctttcgctcattttgaattaaggtcctttcgtcatgcaaatttggggaacatcaaaagagacaaagactagggaccactatttcttacagttcccctcatggtctgagaatatgctgga

SEQ ID NO: 6517 - DNA, 445 bp, Artificial; identical to SEQ ID NO: 6267
  TaSBEIIa  allele with mutations introduced by TALEN pair TaSBEIIa_T01

SEQ ID NO: 6518 - DNA, 464 bp, Artificial; identical to SEQ ID NO: 6377
  TaSBEIIa  allele with mutations introduced by TALEN pair TaSBEIIa_T01

SEQ ID NO: 6519 - DNA, 414 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagctactttcgctcattttgaattaaggtccttcgtcatgcaaatttggggaacatcaaagagacaaagactagggaccactatttcttacagttcccctcatggtctgagaatatgctggga

SEQ ID NO: 6520 - DNA, 444 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 6521 - DNA, 423 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6522 - DNA, 338 bp, Artificial; identical to SEQ ID NO: 6119
  TaSBEIIa  allele with mutations introduced by TALEN pair TaSBEIIa_T01

SEQ ID NO: 6523 - DNA, 402 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagatattttgaattaaggtccttcgtcatgcaaatttggggaacatcaaagagacaaagactagggaccactatttctacagttccctcatggtctgagaatatgctggga

SEQ ID NO: 6524 - DNA, 459 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaaccaggagatgggcagaaaatatacgagattgacccaacgcatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6525 - DNA, 340 bp, Artificial; identical to SEQ ID NO: 6356
  TaSBEIIa  allele with mutations introduced by TALEN pair TaSBEIIa_T01

SEQ ID NO: 6526 - DNA, 451 bp, Artificial; identical to SEQ ID NO: 6371
  TaSBEIIa  allele with mutations introduced by TALEN pair TaSBEIIa_T01

SEQ ID NO: 6527 - DNA, 453 bp, Artificial
  TaSBEIIa  allele with mutations introduced by TALEN pair TaSBEIIa_T01
tcagtggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcggtgggggagaaaccgcgagttgtcccaaaaccaggagatgggcagaaaatatacgagattttcggagccatcttgactaccggtaatgcctaccgctgctttcgctcattttgaatttaaggtcctttcatcatgcaaatttgggaacatcaaagagacaaagactagggaccaccatttcatacagatcccctcgtggtctgagatatgctggga

SEQ ID NO: 6528 - DNA, 449 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgttgactaccggtaatgcctacccgctactttcgctcattttgaattaagtcctttcgtcatgcaaatttggggaacatcaaagagacaaagactagggaccactatttcttacattcccctcatggtctgagaatatgctggga

SEQ ID NO: 6529 - DNA, 393 bp, Artificial; identical to SEQ ID NO: 6210
  TaSBEIIa  allele with mutations introduced by TALEN pair TaSBEIIa_T01

SEQ ID NO: 6530 - DNA, 455 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttttcggagccatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 6531 - DNA, 444 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctgctttcgctcattttgaattaaggtcctttcatcatgcaaatttggggaacatcaaagagacaaagactagggaccaccatttcatacagatccctcgtggtctgagaatatgctggga

SEQ ID NO: 6532 - DNA, 440 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagtcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 6533 - DNA, 386 bp, Artificial
  TaSBEIIa  allele with mutations introduced by TALEN pair TaSBEIIa_T01
  misc_feature (364): n is a or c or t or g
tcagatggatgtgcattagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggctcattttgaattaaggtcctttcgtcatgcaaaatttgggaacatcaaagagacaaagactagggaccactatttctacagttcccctnatggtctgagaatatgctggga

SEQ ID NO: 6534 - DNA, 450 bp, Artificial; identical to SEQ ID NO: 6343
  TaSBEIIa  allele with mutations introduced by TALEN pair TaSBEIIa_T01

SEQ ID NO: 6535 - DNA, 421 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 6536 - DNA, 446 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgcatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 6537 - DNA, 418 bp, Artificial; identical to SEQ ID NO: 6375
  TaSBEIIa  allele with mutations introduced by TALEN pair TaSBEIIa_T01

SEQ ID NO: 6538 - DNA, 469 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6539 - DNA, 336 bp, Artificial; identical to SEQ ID NO: 6365
  TaSBEIIa  allele with mutations introduced by TALEN pair TaSBEIIa_T01

SEQ ID NO: 6540 - DNA, 460 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctcggagccatcttgactaccggtaatgcctaccgctactttcgctcattttgaattaaggtcctttcgtcatgcaaatttgggaacatcaaagagacaaagactagggaccactattcttacagttcccctcatggtctgagaatatgctggga

SEQ ID NO: 6541 - DNA, 452 bp, Artificial
  TaSBEIIa  allele with mutations introduced by TALEN pair TaSBEIIa_T01
  misc_feature (429): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaagattttcggagccatcttgactaccggtaatgcctacccgctaatttcgctcattttgaattaaggtcctttcatcatgcaaatttggggaacatcaaagaggcaaagactagggatcactatttcatacagttccccctanatggtctgagaatatgcgtggga

SEQ ID NO: 6542 - DNA, 450 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgcaccggtaatgcctacccgctaatttcgctcattttgaattaaggtcctttcatcatgcaaatttggggaacatcaaagaggcaaagactagggaccactatttcatacagttcccctcactggtctgagaatatgctggga

SEQ ID NO: 6543 - DNA, 456 bp, Artificial; identical to SEQ ID NO: 6142
  TaSBEIIa  allele with mutations introduced by TALEN pair TaSBEIIa_T01

SEQ ID NO: 6544 - DNA, 412 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatacccgctactttcgctcattttgaattaaggtcctttcgtcatgcaaatttggggaacatcaaagagacaaagactagggaccactatttcttacagttccctcatggtctgagaatatgctggga

SEQ ID NO: 6545 - DNA, 465 bp, Artificial; identical to SEQ ID NO: 6208
  TaSBEIIa  allele with mutations introduced by TALEN pair TaSBEIIa_T01

SEQ ID NO: 6546 - DNA, 455 bp, Artificial; identical to SEQ ID NO: 6447
  TaSBEIIa  allele with mutations introduced by TALEN pair TaSBEIIa_T01

SEQ ID NO: 6547 - DNA, 378 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcctttcgctcattttgaattaaggtcctttcgtcatgcaaatttgggaacatcaaagagacaaagactagggaccactatttcttacagttcccctcatggtctgagaatatgctggga

SEQ ID NO: 6548 - DNA, 380 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcctttcgctcattttgaattaaggtcctttcgtcatgcaaaatttggggaacatcaaagagacaaagactagggaccactatttcttacagttcccctcatggtctgagaatatgctggga

SEQ ID NO: 6549 - DNA, 458 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgattttcggagccatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 6550 - DNA, 466 bp, Artificial
  TaSBEIIa  allele with mutations introduced by TALEN pair TaSBEIIa_T01
  misc_feature (444): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgaaagccatcttgactaccggtaatgcctacccgctaatttcgctcattttgaattaaggtcctttcatcatgcaaatttggggaacatcaaagaggcaaagactagggaccactatttcatacagttcccctnatggtctgagaatatgctggga

SEQ ID NO: 6551 - DNA, 430 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6552 - DNA, 343 bp, Artificial; identical to SEQ ID NO: 6125
  TaSBEIIa  allele with mutations introduced by TALEN pair TaSBEIIa_T01

SEQ ID NO: 6553 - DNA, 335 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaggagttaaggaactagtcgaaggtcctttcatcatgcaaatttggggaacatcaaagagacaaagactagggaccaccatttcatacagatccctgtggtctgagaatatgctggga

SEQ ID NO: 6554 - DNA, 457 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6555 - DNA, 456 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcccatcttgactaccggtaatgcctacccgctactttcgctcattttgattaaggtcctttcgtcatgcaaatttggggaacatcaaagagacaaagactagggaccactatttcttacagttcccctcatggtctgagaatatgctggga

SEQ ID NO: 6556 - DNA, 442 bp, Artificial
  TaSBEIIa  allele with mutations introduced by TALEN pair TaSBEIIa_T01
tcagatggatgtgcttctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttgactaccggtaatgcctacccgctgcttttcgctcattttgaattaaggtcctttcatcatgcaaatttggggaacatcaaagagacaaagactagggaccaccatttcatacagatcccctcgtggtctgagaatatgctggga

SEQ ID NO: 6557 - DNA, 455 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtcccaaaaccaggagatgggcagaaaatatacgagattgacccggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6558 - DNA, 455 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6559 - DNA, 442 bp, Artificial; identical to SEQ ID NO: 6498
  TaSBEIIa  allele with mutations introduced by TALEN pair TaSBEIIa_T01

SEQ ID NO: 6560 - DNA, 444 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatcggagccatcttgactaccggtaatgcctacccgctaatttcgctcattttgaattaaggtcctttcatcatgcaaatttgggaacatcaaagaggcaaagactagggaccactattcatacagttcccctcatggtctgagaatatgctggga

SEQ ID NO: 6561 - DNA, 440 bp, Artificial; identical to SEQ ID NO: 6178
  TaSBEIIa  allele with mutations introduced by TALEN pair TaSBEIIa_T01

SEQ ID NO: 6562 - DNA, 444 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctactttcgctcattttgaattaaggtcctttcgtcatgcaaatttggggaactatcaaagagacaaagactagggaccactattcttacagttcccctcatggtctgagaatatgctggga

SEQ ID NO: 6563 - DNA, 315 bp, Artificial; identical to SEQ ID NO: 6456
  TaSBEIIa  allele with mutations introduced by TALEN pair TaSBEIIa_T01

SEQ ID NO: 6564 - DNA, 450 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctacccgctgctttcgctcattttgaattaaggtcctttcatcatgcaaatttggggaacatcaaagagacaaagactagggaccaccatttcatacagatccctcgtggtctgagaatatgctggga

SEQ ID NO: 6565 - DNA, 414 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6566 - DNA, 397 bp, Artificial
  TaSBEIIa  allele with mutations introduced by TALEN pair TaSBEIIa_T01
tcagatgatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgatttcgctcattttgaattaaggtcctttcatcatgcaaatttggggaacatcaaagaggcaaagactagggaccactatttcatacagttcccctcatggtctgagaatatgctggga

SEQ ID NO: 6567 - DNA, 454 bp, Artificial; identical to SEQ ID NO: 6244
  TaSBEIIa  allele with mutations introduced by TALEN pair TaSBEIIa_T01

SEQ ID NO: 6568 - DNA, 453 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctaccgctgctttcgctcattttgaattaggtcctttcatcatgcaaattttgggaacatcaaagagacaaagactagggaccaccatttcatacagatcccctcgtggtctgagaatatgctggga

SEQ ID NO: 6569 - DNA, 420 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgcctacccgctgctttcgctcattttgaattaaggtcctttcatcatgcaaatttggggaacatcaaagagacaaagactagggaccaccatttcatacagatccctcgtggtctgagatatgctggga

SEQ ID NO: 6570 - DNA, 359 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacgaggggggactgcagaaaaacttgaatcttcagaaccgactcaaggcattgtggaaacaatcactgatggtgtaaccaaggagttaaggaactagtcgtgggggagaaaccgcgagaattaaggtcctttcgtcatgcaaatttggggaacatcaaagagacaaagactagggaccactatttcttacagttcccctcatggtctgagaatatgctggga

SEQ ID NO: 6571 - DNA, 427 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaaatatacggtaatgcctaccgcttacttcgctcattttgaattaaggtcctttcgtcatgcaaatttggggaacatcaaagagacaaagactagggaccactatttcttacagttcccctcatggtctgagaatatgctggga

SEQ ID NO: 6572 - DNA, 484 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctaccgctgctttcgctcattttgaattaaggtcctttcatcatgcaaatttggggaacatcaaagagacaaagactaggaccaccatttcatacagatccctcgtggtctgagaatatgctgggactagacgtgtcgaacgacgacacacgggaggtagag

SEQ ID NO: 6573 - DNA, 449 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctacccgctgctttcgctcattttgaattaaggtcctttcatcatgcaaatttgggaacatcaaagagacaaagactaggaccaccatttcatacagatcccctcgtggtctgagaatatgctggga

SEQ ID NO: 6574 - DNA, 470 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgatttcggagccatcttgactaccggtaatgcctacccgctgctttcgctcattttgaattaaggtcctttcatcatgcaaatttggggaacatcaaagagaacaaagactagggaccaccatttcatacagatcccctcgtggtctgagaatatgctggga

SEQ ID NO: 6575 - DNA, 465 bp, Artificial
  TaSBEIIa  allele with mutations introduced by TALEN pair TaSBEIIa_T01
tcagatggaatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgtttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6576 - DNA, 456 bp, Artificial; identical to SEQ ID NO: 6380
  TaSBEIIa  allele with mutations introduced by TALEN pair TaSBEIIa_T01

SEQ ID NO: 6577 - DNA, 420 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggctaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6578 - DNA, 471 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttcggagccatcttgactaccggtaatgcctacccgctgctttcgctcattttgaattaaggtcctttcatcatgcaaatttggggaacatacaaagagacaaagactagggaccaccatttcatacagactccccctcgtggtctagaagaatatgcgtggga

SEQ ID NO: 6579 - DNA, 430 bp, Artificial; identical to SEQ ID NO: 6551
  TaSBEIIa  allele with mutations introduced by TALEN pair TaSBEIIa_T01

SEQ ID NO: 6580 - DNA, 397 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgatttcgctcattttgaattaaggtcctttcatcatgcaaatttgggaacatcaaagaggcaaagactagggaccactatttcatacagttcccctcatggtctgagaatatgctggga

SEQ ID NO: 6581 - DNA, 382 bp, Artificial
  TaSBEIIa  allele with mutations introduced by TALEN pair TaSBEIIa_T01
tcagatggatgtgcattactagcaagaacttcacaaaataatgcgactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaaccaggagatgggtcctttcatcatgcaaaatttggggaacatcaaagaggcaaaagactagggaccactatttcatacagttcccctcatggtctgagaatatgctggga

SEQ ID NO: 6582 - DNA, 429 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaataccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6583 - DNA, 451 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccatcttgactaccggtaatgcctacccgctaatttcgctcattttgaattaaggtcctttcatcatgcaaatttggggaacatcaaagaggcaaagactagggaccactattcatacagttccctcatggtctgagaatatgctggga

SEQ ID NO: 6584 - DNA, 416 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6585 - DNA, 394 bp, Artificial
  TaSBEIIa  allele with mutations introduced by TALEN pair TaSBEIIa_T01
tcagatggatggtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagactttcgctcattttgaattaaggtcctttcgtcatgcaaatttggggaacatcaaagagacaaagactagggaccactatttcttacagttcccctcatggtctgagaatatgctggga

SEQ ID NO: 6586 - DNA, 439 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6587 - DNA, 334 bp, Artificial
  TaSBEIIa  allele with mutations introduced by TALEN pair TaSBEIIa_T01
tcagatggatgtgctctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagacatgcaaatttggggaacatcaaagaggcaaagactagggaccactatttcatacagttcccctcatggtctgagaatatgctggga

SEQ ID NO: 6588 - DNA, 341 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaccgactcaagcattgtggaaacaatcactgatggtgtaaccaaaggagttaaggaactagtcgtgggggagaaaccgcgagttgtccaaatttggggaacatcaaagagacaaagactagggaccactatttcttacagttcccctcatggtatgagaatatgctggga

SEQ ID NO: 6589 - DNA, 447 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgcatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6590 - DNA, 451 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctaccggtaatgcctacccgctaatttcgctcattttgaattaaggtcctttcatcatgcaaatttggggaacatcaaagaggcaaagactagggaccactatttcatacagttcccctcatggtctgagaatactgctggga

SEQ ID NO: 6591 - DNA, 439 bp, Artificial; identical to SEQ ID NO: 6214
  TaSBEIIa  allele with mutations introduced by TALEN pair TaSBEIIa_T01

SEQ ID NO: 6592 - DNA, 452 bp, Artificial
  TaSBEIIa  allele with mutations introduced by TALEN pair TaSBEIIa_T01
  misc_feature (221): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggngttaaggaactagtcgtgggggagaaaccgcgagttgtcccaaaaccaggagatgggcagaaaatatacgagatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctgga

SEQ ID NO: 6593 - DNA, 451 bp, Artificial
  TaSBEIIa  allele with mutations introduced by TALEN pair TaSBEIIa_T01
  misc_feature (89): n is a or c or t or g
tcagatggatgtgcattctagcaagaacttcacgaaataatgcgactgtttgtggtttcgttagtctgctctacaattgctattttcgngctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaataaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 6594 - DNA, 399 bp, Artificial
  TaSBEIIa  allele with mutations introduced by TALEN pair TaSBEIIa_T01
  misc_feature (269): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccnggagatgggcagctttcgctcattttgaattaaggtccttcgtcatgcaaatttggggaacatcaaagagacaaagactagggaccactatttcttacagttcccctcatggtctgagaatatgctggga

SEQ ID NO: 6595 - DNA, 427 bp, Artificial; identical to SEQ ID NO: 6312
  TaSBEIIa  allele with mutations introduced by TALEN pair TaSBEIIa_T01

SEQ ID NO: 6596 - DNA, 436 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6597 - DNA, 451 bp, Artificial; identical to SEQ ID NO: 6371
  TaSBEIIa  allele with mutations introduced by TALEN pair TaSBEIIa_T01

SEQ ID NO: 6598 - DNA, 454 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 6599 - DNA, 455 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcatcttgactaccggtaatgcctacccgctactttcgctcattttgaatttaaggtcctttcgtcatgcaaatttggggaacatcaaagagacaaagactagggaccactattcttacagttcccctcatggtctgagaatatgctggga

SEQ ID NO: 6600 - DNA, 339 bp, Artificial; identical to SEQ ID NO: 6123
  TaSBEIIa  allele with mutations introduced by TALEN pair TaSBEIIa_T01

SEQ ID NO: 6601 - DNA, 455 bp, Artificial
  TaSBEIIa  allele with mutations introduced by TALEN pair TaSBEIIa_T01
tcagatggatgtgcattctagcaagaacttcacaaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 6602 - DNA, 439 bp, Artificial; identical to SEQ ID NO: 6214
  TaSBEIIa  allele with mutations introduced by TALEN pair TaSBEIIa_T01

SEQ ID NO: 6603 - DNA, 436 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 6604 - DNA, 453 bp, Artificial; identical to SEQ ID NO: 6432
  TaSBEIIa  allele with mutations introduced by TALEN pair TaSBEIIa_T01

SEQ ID NO: 6605 - DNA, 444 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccttgactaccggtaatgcctaccgctactttcgctcattttgaattaaggtcctttcgtcatgcaaatttggggaacatcaaagagacaaagactagggaccactatttctacagttcccctcatggtctgagaatatgctggga

SEQ ID NO: 6606 - DNA, 454 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaactacaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 6607 - DNA, 396 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagactttcgctcattttgaattaaggtcctttcgtcatgcaaatttggggaacatcaaaagagacaaagactagggaccactattttcttacagttccccctcatggtctgagaatatgctggga

SEQ ID NO: 6608 - DNA, 429 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccctacccgctacttcgctcattttgaattaaggtcctttcgtcatgcaaatttggggaacatcaaagagacaaaagactagggaccactatttcttacagttcccctcatggtctgagaatatgctggga

SEQ ID NO: 6609 - DNA, 453 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgagccatcttgactaccggtaatgcctacccgctgctttcgctcattttgaattaaggtcctttcattcatgcaaatttggggaacatcaaagagacaaagactagggaccaccatttcatacagactcccctcgtggtctgagaatatgctggga

SEQ ID NO: 6610 - DNA, 390 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggctcattttgaattaaggtcctttcgtcatgcaaatttggggaacatcaaagagacaaagactagggaccactatttcttacagttcccctcatggtctgagaatatgctggga

SEQ ID NO: 6611 - DNA, 457 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccggagccatcttgactaccggtaatgcctacccgctgctttcgctcattttgaattaaggtcctttcatcatgcaaatttgggaacatcaaagagacaaagactagggaccaccatttcatacagactcccctcgtggtctgagaatatgctggga

SEQ ID NO: 6612 - DNA, 429 bp, Artificial; identical to SEQ ID NO: 6160
  TaSBEIIa  allele with mutations introduced by TALEN pair TaSBEIIa_T01

SEQ ID NO: 6613 - DNA, 437 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagctaccggtaatgcctacccgctgcttttcgctcattttgaattaaggtcctttcatcatgcaaatttggggaacatcaaagagacaaagactagggaccaccatttcatacagatcccctcgtggtctgagaatatgctggga

SEQ ID NO: 6614 - DNA, 463 bp, Artificial; identical to SEQ ID NO: 6333
  TaSBEIIa  allele with mutations introduced by TALEN pair TaSBEIIa_T01

SEQ ID NO: 6615 - DNA, 428 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttagtcccaaaaccaggagatgggcaggactaccggtaatgcctacccgctaatttcgctcattttgaattaaggtcctttcatcatgcaaatttggggaacatcaaagaggcaaagactagggaccactattcatacagttcccctcatggtctgagaatatgctggga

SEQ ID NO: 6616 - DNA, 460 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 6617 - DNA, 456 bp, Artificial; identical to SEQ ID NO: 6380
  TaSBEIIa  allele with mutations introduced by TALEN pair TaSBEIIa_T01

SEQ ID NO: 6618 - DNA, 339 bp, Artificial; identical to SEQ ID NO: 6123
  TaSBEIIa  allele with mutations introduced by TALEN pair TaSBEIIa_T01

SEQ ID NO: 6619 - DNA, 389 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagactttcgctcattttgaattaaggtcctttcgtcatgcaaatttggggaacatcaaagagacaaagactagggaccactatttcttacagttcccctcatggtctgagaatatgct

SEQ ID NO: 6620 - DNA, 452 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgagccatcttgactaccggtaatgcctacccgctaatttcgctcattttgaattaaggtcctttcatcatgcaaatttggggaacatcaaagaggcaaagactagggaccactattcatacagttcccctcatggtctgagaatatgctggga

SEQ ID NO: 6621 - DNA, 458 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgcatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6622 - DNA, 452 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcatcttgactaccggtaatgcctaccgctactttcgctcattttgaattaaggtcctttcgtcatgcaaatttggggaacatcaaagagacaaagactagggaccactatttcttacagttccctcatggtctgagatatgctggga

SEQ ID NO: 6623 - DNA, 453 bp, Artificial
  TaSBEIIa  allele with mutations introduced by TALEN pair TaSBEIIa_T01
  misc_feature (332): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccatcttgactaccggtaatgcctacccgntaatttcgctcattttgaattaaggtcctttcatcatgcaaatttggggaacatcaaagaggcaaagactagggaccactatttcatacagttcccctcatggtctgagaatatgctggga

SEQ ID NO: 6624 - DNA, 380 bp, Artificial; identical to SEQ ID NO: 6194
  TaSBEIIa  allele with mutations introduced by TALEN pair TaSBEIIa_T01

SEQ ID NO: 6625 - DNA, 449 bp, Artificial
  TaSBEIIa  allele with mutations introduced by TALEN pair TaSBEIIa_T01
  misc_feature (245): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggganaaaccgcgagttgtcccaaaaccaggagatgggcagaaaatatacgagattgaccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6626 - DNA, 393 bp, Artificial; identical to SEQ ID NO: 6210
  TaSBEIIa  allele with mutations introduced by TALEN pair TaSBEIIa_T01

SEQ ID NO: 6627 - DNA, 449 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgagccatcttgactaccggtaatgcctaccgctgctttcgctcattttgaattaaggtcctttcatcatgcaaatttggggaacatcaaagagacaaagactagggaccaccatttcatacagatcccctgtggtctgagaatatgctggga

SEQ ID NO: 6628 - DNA, 439 bp, Artificial; identical to SEQ ID NO: 6214
  TaSBEIIa  allele with mutations introduced by TALEN pair TaSBEIIa_T01

SEQ ID NO: 6629 - DNA, 420 bp, Artificial; identical to SEQ ID NO: 6213
  TaSBEIIa  allele with mutations introduced by TALEN pair TaSBEIIa_T01

SEQ ID NO: 6630 - DNA, 401 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggctgctttcgctcattttgaattaaggtcctttcatcatgcaaatttggggaacatcaaagagacaaagactagggaccaccatttcatacagatcccctcgtggtctgagaatatgctggga

SEQ ID NO: 6631 - DNA, 456 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccggagccatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 6632 - DNA, 425 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacatgcctacccgctgcttttcgctcattttgaattaaggtcctttcatcatgcaaatttggggaacatcaaagagacaaagactagggaccaccatttcatacagatcccctcgtggtctgagaatatgctggga

SEQ ID NO: 6633 - DNA, 456 bp, Artificial; identical to SEQ ID NO: 6142
  TaSBEIIa  allele with mutations introduced by TALEN pair TaSBEIIa_T01

SEQ ID NO: 6634 - DNA, 428 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgcatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6635 - DNA, 339 bp, Artificial; identical to SEQ ID NO: 6123
  TaSBEIIa  allele with mutations introduced by TALEN pair TaSBEIIa_T01

SEQ ID NO: 6636 - DNA, 369 bp, Artificial; identical to SEQ ID NO: 6369
  TaSBEIIa  allele with mutations introduced by TALEN pair TaSBEIIa_T01

SEQ ID NO: 6637 - DNA, 424 bp, Artificial
  TaSBEIIa  allele with mutations introduced by TALEN pair TaSBEIIa_T01
tcagatggatgtgcattctatcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6638 - DNA, 398 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaacctacccgctgctttcgctcattttgaattaaggtcctttcatcatgcaaatttggggaacatcaaagagacaaagactagggaccaccatttcatacagatcccctcgtggtctgagaatatgctgggga

SEQ ID NO: 6639 - DNA, 453 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6640 - DNA, 465 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgaggagccatcttgactaccggtaatgcctacccgctaatttcgctcattttgaattaaggtcctttcatcatgcaaatttggggaacatcaaagaggcaaagactagggaccactattcatacagttcccctcatggtctgagaatatgctggga

SEQ ID NO: 6641 - DNA, 442 bp, Artificial
  TaSBEIIa  allele with mutations introduced by TALEN pair TaSBEIIa_T01
tcagtggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcaagaaaatatacgagattgacccaacgccggtaatgcctacccgctactttcgctcattttgaatttaaggtccttcgtcatgcaaatttggggaacatcaaagagacaaagctaggaccactatttcttacagttcccctcatggtctgagaatatgctggga

SEQ ID NO: 6642 - DNA, 445 bp, Artificial; identical to SEQ ID NO: 6252
  TaSBEIIa  allele with mutations introduced by TALEN pair TaSBEIIa_T01

SEQ ID NO: 6643 - DNA, 414 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatacccgctactttcgctcattttgaattaaggtcctttcgtcatgcaaatttggggaacatcaaagagacaaagactagggaccactatttcttacagttcccctcatggtctgagaatatggctggga

SEQ ID NO: 6644 - DNA, 439 bp, Artificial; identical to SEQ ID NO: 6214
  TaSBEIIa  allele with mutations introduced by TALEN pair TaSBEIIa_T01

SEQ ID NO: 6645 - DNA, 443 bp, Artificial
  TaSBEIIa  allele with mutations introduced by TALEN pair TaSBEIIa_T01
  misc_feature (419): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaatgcctacccgctactttcgctcattttgaattaaggtcctttcgtcatgcaaatttggggaacatcaaagagacaaagactagggaccactatttcttacagttccccncatggtctgagaattatgctggga

SEQ ID NO: 6646 - DNA, 365 bp, Artificial; identical to SEQ ID NO: 6193
  TaSBEIIa  allele with mutations introduced by TALEN pair TaSBEIIa_T01

SEQ ID NO: 6647 - DNA, 457 bp, Artificial; identical to SEQ ID NO: 6359
  TaSBEIIa  allele with mutations introduced by TALEN pair TaSBEIIa_T01

SEQ ID NO: 6648 - DNA, 373 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttcgctcattttgaattaaggtcctttcatcatgcaaatttggggaacatcaaagagacaaagactagggaccaccatttcatacagatcccctcgtggtctgagaatatgctggga

SEQ ID NO: 6649 - DNA, 414 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 6650 - DNA, 444 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagatttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6651 - DNA, 442 bp, Artificial
  TaSBEIIa  allele with mutations introduced by TALEN pair TaSBEIIa_T01
  misc_feature (287); (420): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatntacgagccatcttgactaccggtaatgcctacccgctactttcgctcattttgaattaaggtcctttcgtcatgcaaatttggggaacatcaaagagacaaagactagggaccactatttcttacagttcccnatggtctaagaatatgctggga

SEQ ID NO: 6652 - DNA, 339 bp, Artificial; identical to SEQ ID NO: 6123
  TaSBEIIa  allele with mutations introduced by TALEN pair TaSBEIIa_T01

SEQ ID NO: 6653 - DNA, 405 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgacattttgaattaaggtcctttcatcatgcaaatttggggaacatcaaagaggcaaagactagggaccactatttcatacagttccctcatggtctgagaatatgctggga

SEQ ID NO: 6654 - DNA, 353 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactgctttcgctcattttgaattaaggtcctttcatcatgcaaatttggggaacatcaaagagacaaagactagggaccaccatttcatacagatcccctcgtggtctgagaatatgctggga

SEQ ID NO: 6655 - DNA, 453 bp, Artificial; identical to SEQ ID NO: 6432
  TaSBEIIa  allele with mutations introduced by TALEN pair TaSBEIIa_T01

SEQ ID NO: 6656 - DNA, 417 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6657 - DNA, 448 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctacccgctgctttcgctcattttgaattaaggtcctttcatcatgcaaatttggggaacatcaaagagacaaagactaggaccacattcatacagatcccctcgtggtctgagaatatgctggga

SEQ ID NO: 6658 - DNA, 465 bp, Artificial
  TaSBEIIa  allele with mutations introduced by TALEN pair TaSBEIIa_T01
tcagatggaatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgtttcggagccatcttgactaccggtaatgcctacccgctactttcgctcattttgaatttaaggtcctttcgtcatgcaaatttggggaacatcaaagagacaaagactagggaccactatttctacagttcccctcatggtctgagaatatgctggga

SEQ ID NO: 6659 - DNA, 435 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagctaccggtaatgcctacccgctgctttcgctcattttgaattaaggtcctttcatcatgcaaatttggggaacatcaaagagacaaagactagggaccacatttcatacagatcccctcgtggtctgagaatatgctggga

SEQ ID NO: 6660 - DNA, 446 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaaagataatgcctacccgctactttcgctcattttgaattaaggtcctttcgtcatgcaaatttggggaacatcaaagagacaaagactagggaccactatttctacagttcccctcatgtctgagaatatgctggga

SEQ ID NO: 6661 - DNA, 465 bp, Artificial; identical to SEQ ID NO: 6259
  TaSBEIIa  allele with mutations introduced by TALEN pair TaSBEIIa_T01

SEQ ID NO: 6662 - DNA, 460 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaagctgaaagccatcttgactaccggtaatgcctacccgctactttcgctcattttgaattaaggtcctttgtcatgcaaatttgggaacatcaaagagacaaagactagggaccactatttcttacagttcccctcatggtctgagaatatgctggga

SEQ ID NO: 6663 - DNA, 364 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgctcattttgaattaaggtccttcgtcatgcaaatttggggaacatcaaagagacaaagactagggaccactattcttacagttcccctcatggtctgagaatatgctggga

SEQ ID NO: 6664 - DNA, 448 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccatcttgactaccggtaatgcctacccgctactttcgctcattttgaattaaggtcctttcgtcatgcaaattggggaacatcaaagagacaaagactagggaccactatttcttacagttcccctcatggtctgagaatatgctggga

SEQ ID NO: 6665 - DNA, 448 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgcatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6666 - DNA, 446 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctgcttttcgctcattttgaattaaggtcctttcatcatgcaaatttggggaacatcaaagagacaaagactagggaccaccatttcatacagatcccctcgtggtctgagaatatgctggga

SEQ ID NO: 6667 - DNA, 433 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattaccggtaatgcctacccgctactttcgctcattttgaattaaggtcctttcgtcatgcaaatttggggaacatcaaagagacaaagactagggaccactattctacagttccctcatggtctgagaatatgctggga

SEQ ID NO: 6668 - DNA, 452 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctaccgctgctttcgctcattttgaattaaggtcctttcatcatgcaaatttgggaacatcaaagagacaaagactaggaccaccatttcatacagatcccctcgtggtctgagaatatgctggga

SEQ ID NO: 6669 - DNA, 416 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6670 - DNA, 445 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 6671 - DNA, 417 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttttcggagccatcttgactaccggtaatgcctacccgctgcttttcgctcattttgaattaaggtcctttcatcatgcaaatttggggaacatcaaagagacaaagactagggaccaccatttcatacagatcccctcgtggtctgagaatatgctggga

SEQ ID NO: 6672 - DNA, 423 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacgaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6673 - DNA, 461 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctcggagccatcttgactaccggtaatgcctacccgctactttcgctcattttgaattaaggtcctttcgtcatgcaaatttgggaacatcaaagagacaaagactagggaccactatttcttacagttccctcatggtctgagaatatgctggga

SEQ ID NO: 6674 - DNA, 464 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaactttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6675 - DNA, 447 bp, Artificial
  TaSBEIIa  allele with mutations introduced by TALEN pair TaSBEIIa_T01
  misc_feature (386): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccttgactaccggtaatgcctacccgctactttcgctcattttgaattaaggtcctttcgtcatgcaaattttggggaacatcaaagngacaaagactagggaccactatttcttacagttcccctcatggtctgagaatatgctggga

SEQ ID NO: 6676 - DNA, 435 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagctaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 6677 - DNA, 364 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtacccgctgctttcgctcattttgaattaaggtcctttcatcatgcaaatttgggaacatcaaagagacaaagactaggaccaccatttcatacagatcccctcgtggtctgagaatatgctggga

SEQ ID NO: 6678 - DNA, 406 bp, Artificial; identical to SEQ ID NO: 6313
  TaSBEIIa  allele with mutations introduced by TALEN pair TaSBEIIa_T01

SEQ ID NO: 6679 - DNA, 453 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttcggagccatcttgactaccggtaatgcctaccgctgctttcgctcattttgaattaaggtcctttcatcatgcaaatttgggaacatcaaagagacaaagactagggaccaccatttcatacagactcccctcgtggtctgagaatatgctggga

SEQ ID NO: 6680 - DNA, 436 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6681 - DNA, 438 bp, Artificial
  TaSBEIIa  allele with mutations introduced by TALEN pair TaSBEIIa_T01
  misc_feature (269): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccnggagatgggcagaaaatataatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6682 - DNA, 437 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6683 - DNA, 377 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggtcctttcatcatgcaaatttggggaacatcaaagaggcaaagactagggaccactatttcatacagttcccctcatggtctgagaatatgctggga

SEQ ID NO: 6684 - DNA, 448 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccatcttgactaccggtaatgcctacccgctactttcgctcattttgaattaaggtcctttcgtcatgcaaatttgggaacatcaaagagacaaagactagggaccactatttcttacagttcccctcatggtctgaagatatgctggga

SEQ ID NO: 6685 - DNA, 412 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatccgctgctttcgctcattttgaattaaggtcctttcatcatgcaaatttggggaacatcaaagagacaaagactagggaccaccatttcatacagatccctcgtggtctgagatatgctggga

SEQ ID NO: 6686 - DNA, 431 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctaatttcgctcattttgaattaaggtcctttcatcatgcaaatttggggaacatcaaaagaggcaaagactagggaccactatttcatacagttcccctcatggtctgagaatatgctggga

SEQ ID NO: 6687 - DNA, 467 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtccaaaaaaccaggagatgggcagaaaatatacgagattgacccaacgctttcggagccatcttgactaccggtaatgcctacccgctactttcgctcattttgaattaaggtcctttcgtcatgcaaatttggggaacatcaaagagacaaagactagggaccactatttcttacacgttcccctcatggtctgagaatatgctggga

SEQ ID NO: 6688 - DNA, 424 bp, Artificial; identical to SEQ ID NO: 6190
  TaSBEIIa  allele with mutations introduced by TALEN pair TaSBEIIa_T01

SEQ ID NO: 6689 - DNA, 449 bp, Artificial; identical to SEQ ID NO: 6275
  TaSBEIIa  allele with mutations introduced by TALEN pair TaSBEIIa_T01

SEQ ID NO: 6690 - DNA, 444 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctactttcgctcattttgaattaaggtcctttcgtcatgtcaaatttggggaacatcaaagagacaaagactagggaccactatttctacagttcccctcatggtctgagaatatgctggga

SEQ ID NO: 6691 - DNA, 433 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctatttttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccctacccgctactttcgctcattttgaattaaggtccttttcgtcaatgcaaaattttggggaacatcaaagagacaaagactagggaccactatttcttacagttccctcatggtctgagaatatgctggga

SEQ ID NO: 6692 - DNA, 408 bp, Artificial
  TaSBEIIa  allele with mutations introduced by TALEN pair TaSBEIIa_T01
tcagatggatgttgcattactagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatttcgctcattttgaattaaggtcctttcgtcatgcaaattttggggaacatcaaagagacaaagactagggaccactatttcttacagttcccctcatggtctgagaatatgctggga

SEQ ID NO: 6693 - DNA, 407 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6694 - DNA, 447 bp, Artificial; identical to SEQ ID NO: 6437
  TaSBEIIa  allele with mutations introduced by TALEN pair TaSBEIIa_T01

SEQ ID NO: 6695 - DNA, 429 bp, Artificial; identical to SEQ ID NO: 6160
  TaSBEIIa  allele with mutations introduced by TALEN pair TaSBEIIa_T01

SEQ ID NO: 6696 - DNA, 428 bp, Artificial
  TaSBEIIa  allele with mutations introduced by TALEN pair TaSBEIIa_T01
tcagatggatgtgcattactagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaaacaatcactgatggtgtaaccaaaggagttaaggaactagtcgtgggggagaaaccgcgagttgtcccaaaaccaggagatgggccatcttagactaccggtaatgcctacccgctgctttcgctcattttgaattaagtcctttcatcatgcaaatttgggaacatcaaagagacaaagctagggaccacatttcatacagatcccctgtggtctgagaatatgctggga

SEQ ID NO: 6697 - DNA, 448 bp, Artificial; identical to SEQ ID NO: 6329
  TaSBEIIa  allele with mutations introduced by TALEN pair TaSBEIIa_T01

SEQ ID NO: 6698 - DNA, 444 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6699 - DNA, 445 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgcaccggtaatgcctacccgctaatttcgctcattttgaattaaggtcctttcatcatgcaaatttgggaacatcaagaggcaaagactagggaccactattcatacagttcccctcatggtctgagatatgctggga

SEQ ID NO: 6700 - DNA, 375 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaaattaaggtcctttcatcatgcaaatttgggaacatcaaagaggcaaagactagggaccactatttcatacagttcccctcatggtctgagaatatgctggga

SEQ ID NO: 6701 - DNA, 328 bp, Artificial; identical to SEQ ID NO: 6144
  TaSBEIIa  allele with mutations introduced by TALEN pair TaSBEIIa_T01

SEQ ID NO: 6702 - DNA, 449 bp, Artificial; identical to SEQ ID NO: 6275
  TaSBEIIa  allele with mutations introduced by TALEN pair TaSBEIIa_T01

SEQ ID NO: 6703 - DNA, 428 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggccatcttgactaccggtaatgcctacccgctgctttcgctcattttgaattaaggtcctttcatcatgcaaatttgggaacatcaaagagacaaagactagggaccacatttcatacagatcccctcgtggtctgagaatatgctggga

SEQ ID NO: 6704 - DNA, 427 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtcccaaaaccaggagatgggcagaaaatatacgagattgaccctaccgctactttcgctcattttgaattaaggtcctttcgtcatgcaaatttggggaacatcaaagagacaaagactagggaccactatttcttacagttcccctcatggtctgagaatatgctggga

SEQ ID NO: 6705 - DNA, 440 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgacttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6706 - DNA, 457 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgcatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 6707 - DNA, 438 bp, Artificial; identical to SEQ ID NO: 6350
  TaSBEIIa  allele with mutations introduced by TALEN pair TaSBEIIa_T01

SEQ ID NO: 6708 - DNA, 429 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6709 - DNA, 394 bp, Artificial
  TaSBEIIa  allele with mutations introduced by TALEN pair TaSBEIIa_T01
  misc_feature (270): n is a or c or t or g
tcagatggatggtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccnggagactttcgctcattttgaattaaggtcctttcgtcatgcaaatttggggaacatcaaagagacaaagactagggaccactatttcttacagttcccctcatggtctgagaatatgctggga

SEQ ID NO: 6710 - DNA, 424 bp, Artificial; identical to SEQ ID NO: 6190
  TaSBEIIa  allele with mutations introduced by TALEN pair TaSBEIIa_T01

SEQ ID NO: 6711 - DNA, 439 bp, Artificial; identical to SEQ ID NO: 6214
  TaSBEIIa  allele with mutations introduced by TALEN pair TaSBEIIa_T01

SEQ ID NO: 6712 - DNA, 436 bp, Artificial
  TaSBEIIa  allele with mutations introduced by TALEN pair TaSBEIIa_T01
  misc_feature (428): n is a or c or t or g
tcagtggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatcttgactaccggtaatgcctacccgctgctttcgctcattttgaattaaggtcctttcatcatgcaaatttggggaacatcaaagagacaaagactagggaccaccatttcatacagactcccctcgtggtctgagaatntgctggga

SEQ ID NO: 6713 - DNA, 438 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaataccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6714 - DNA, 426 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6715 - DNA, 446 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 6716 - DNA, 398 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaacaggagatgggcagctttcgctcattttgaattaaggtcctttcgtcatgcaaatttggggaacatcaaagagacaaagactagggaccactatttctacagttcccctcatggtctgagaatatgctggga

SEQ ID NO: 6717 - DNA, 460 bp, Artificial; identical to SEQ ID NO: 6616
  TaSBEIIa  allele with mutations introduced by TALEN pair TaSBEIIa_T01

SEQ ID NO: 6718 - DNA, 442 bp, Artificial
  TaSBEIIa  allele with mutations introduced by TALEN pair TaSBEIIa_T01
  misc_feature (374): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttgactaccggtaatgcctacccgctgctttcgctcattttgaattaaggtcctttcatcatgcaaatttggggaacntcaaagagacaaagactagggaccaccatttcatacagatcccctcgtggtctgagaatatgctggga

SEQ ID NO: 6719 - DNA, 441 bp, Artificial; identical to SEQ ID NO: 6344
  TaSBEIIa  allele with mutations introduced by TALEN pair TaSBEIIa_T01

SEQ ID NO: 6720 - DNA, 445 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 6721 - DNA, 400 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgatttcgctcattttgaattaaggtcctttcatcatgcaaattttggggaacatcaaagaggcaaagactagggaccactatttcatacagttcccctcatggtctgagaatatgctgggga

SEQ ID NO: 6722 - DNA, 453 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagatttcggagccatcttgactaccggtaatgcctacccgctactttcgctcattttgaattaaggtcctttcgtcatgcaaatttggggaacatcaaagagacaaagactagggaccactatttcttacagttcccctcatggtatgagaatatgctggga

SEQ ID NO: 6723 - DNA, 451 bp, Artificial; identical to SEQ ID NO: 6228
  TaSBEIIa  allele with mutations introduced by TALEN pair TaSBEIIa_T01

SEQ ID NO: 6724 - DNA, 442 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagtcggagccatcttgactaccggtaatgcctacccgctaatttcgctcattttgaattaaggtcctttcatcatgcaaatttggggaacatacaaagaggcaaagactagggaccactatttcatacagttcccctcatggtctgagaatatgctggga

SEQ ID NO: 6725 - DNA, 455 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6726 - DNA, 446 bp, Artificial
  TaSBEIIa  allele with mutations introduced by TALEN pair TaSBEIIa_T01
  misc_feature (423): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctactttcgctcattttgaattaaggtcctttcgtcatgcaaatttggggaacatcaaagagacaaagactagggaccactatttcttacagttccccctnatggtctgagaatatgcgtggga

SEQ ID NO: 6727 - DNA, 430 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaataccggtaatgcctacccgctaatttcgctcattttgaattaaggtcctttcatcatgcaaatttggggaacatcaaaagaggcaaagactagggaccactatttcatacagttcccctcatggtctgagaatatgctggga

SEQ ID NO: 6728 - DNA, 460 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 6729 - DNA, 338 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagtcaaatttggggaacatcaaagagacaaagactagggaccactattcttacagttcccctcatggtctgagaatatgctggga

SEQ ID NO: 6730 - DNA, 439 bp, Artificial; identical to SEQ ID NO: 6214
  TaSBEIIa  allele with mutations introduced by TALEN pair TaSBEIIa_T01

SEQ ID NO: 6731 - DNA, 457 bp, Artificial; identical to SEQ ID NO: 6359
  TaSBEIIa  allele with mutations introduced by TALEN pair TaSBEIIa_T01

SEQ ID NO: 6732 - DNA, 464 bp, Artificial
  TaSBEIIa  allele with mutations introduced by TALEN pair TaSBEIIa_T01
tcagatggtgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacacttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6733 - DNA, 369 bp, Artificial; identical to SEQ ID NO: 6369
  TaSBEIIa  allele with mutations introduced by TALEN pair TaSBEIIa_T01

SEQ ID NO: 6734 - DNA, 367 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtacccgctgctttcgctcattttgaattaaggtcctttcatcatgcaaatttggggaacatcaaagagacaaagactagggaccaccattttcatacagatcccctcgtggtctgagaatatgctggga

SEQ ID NO: 6735 - DNA, 464 bp, Artificial
  TaSBEIIa  allele with mutations introduced by TALEN pair TaSBEIIa_T01
tcagatggatgtgattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttcggagccatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 6736 - DNA, 451 bp, Artificial; identical to SEQ ID NO: 6371
  TaSBEIIa  allele with mutations introduced by TALEN pair TaSBEIIa_T01

SEQ ID NO: 6737 - DNA, 406 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagatattttgaattaaggtcctttcgtcatgcaaaatttggggaacatcaaagagacaaagactagggaccactatttcttacagttcccctcatggtctgagaatatgctggga

SEQ ID NO: 6738 - DNA, 437 bp, Artificial; identical to SEQ ID NO: 6682
  TaSBEIIa  allele with mutations introduced by TALEN pair TaSBEIIa_T01

SEQ ID NO: 6739 - DNA, 339 bp, Artificial; identical to SEQ ID NO: 6123
  TaSBEIIa  allele with mutations introduced by TALEN pair TaSBEIIa_T01

SEQ ID NO: 6740 - DNA, 448 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagataatttcgctcattttgaattaaggtcctttcatcatgcaaatttggggaacatcaaagaggcaaaagactagggaccactatttcatacagttcccctcatggtctgagaatatgctgggactgaactgccaaggcacacaggggatagg

SEQ ID NO: 6741 - DNA, 439 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgactaccggtaatgcctacccgctgctttcgctcattttgaattaaggtcctttcatcatgcaaatttgggaacatcaaagagacaaagactagggaccacatttcatacagatcccctcgtggtctgagaatatgctggga

SEQ ID NO: 6742 - DNA, 440 bp, Artificial; identical to SEQ ID NO: 6178
  TaSBEIIa  allele with mutations introduced by TALEN pair TaSBEIIa_T01

SEQ ID NO: 6743 - DNA, 456 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtcccaaaaccaggagatgggcagaaaatatacgagattgacccggagccatcttgactaccggtaatgcctacccgctactttcgctcattttgaattaaggtcctttcgtcatgcaaatttggggaacatcaaagagacaaagactagggaccactatttcttacagttcccctcactggtctgagaatatgctggga

SEQ ID NO: 6744 - DNA, 471 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatacaaagagacaaagactagggaccaccatttcatacagatcccctcgtggtctgagaatatgctggga

SEQ ID NO: 6745 - DNA, 452 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatctgactaccggtaatgcctaccgctgctttcgctcattttgaattaaggtcctttcatcatgcaaatttgggaacatcaaagagacaaagactagggaccaccatttcatacagatcccctcgtggtctgagaatatgctggga

SEQ ID NO: 6746 - DNA, 424 bp, Artificial; identical to SEQ ID NO: 6190
  TaSBEIIa  allele with mutations introduced by TALEN pair TaSBEIIa_T01

SEQ ID NO: 6747 - DNA, 344 bp, Artificial; identical to SEQ ID NO: 6216
  TaSBEIIa  allele with mutations introduced by TALEN pair TaSBEIIa_T01

SEQ ID NO: 6748 - DNA, 456 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcatcttgactaccggtaatgcctacccgctactttcgctcattttgaattaaggtcctttcgtcatgcaaatttggggaacatcaaagagacaaagactaggggaccactatttcttacagttcccctcatggtctgagaatatgctggga

SEQ ID NO: 6749 - DNA, 434 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggccatcttgactaccggtaatgcctaccgctgcttttcgctcattttgaattaaggtccttttcatcatgcaaatttggggaaacatcaaaagagacaaagactagggaccaccatttcatacagactcccctcgtggtctgagaatatgctggga

SEQ ID NO: 6750 - DNA, 431 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6751 - DNA, 432 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaaccaggagatgggcagaaaaataccggtaatgcctacccgctaatttcgctcattttgaattaaggtcctttcatcatgcaaaatttggggaacatcaaagaggcaaagactagggaccactatttcatacagttcccctcatggtctgagaatatgctggga

SEQ ID NO: 6752 - DNA, 449 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 6753 - DNA, 440 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttgactaccggtaatgcctaccgctgctttcgctcattttgaattaaggtcctttcatcatgcaaatttggggaacatcaaagagacaaagactagggaccaccatttcatacagatccctcgtggtctgagaatatgctggga

SEQ ID NO: 6754 - DNA, 400 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagctttcgctcattttgaattaaggtcctttcatcatgcaaatttggggaacatcaaagagacaaagactagggaccaccatttcatacagatcccctcgtggtctgagaatatgctggga

SEQ ID NO: 6755 - DNA, 443 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgctggga

SEQ ID NO: 6756 - DNA, 441 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgacttgactaccggtaatgcctacccgctactttcgctcattttgaattaaggtcctttcgtcatgcaaaatttggggaacatcaaaagagacaaagactagggaccactatttcttacagttcccctcatggtctgagaatatgctggga

SEQ ID NO: 6757 - DNA, 446 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagataatttcgctcattttgaattaaggtcctttcatcatgcaaatttggggaacatcaaagaggcaaagactagggaccactatttcatacagttcccctcatggtctgagatatgctgggactgaactgccaaggcacacaggggatagg

SEQ ID NO: 6758 - DNA, 435 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatggtcggagccatcttgactaccggtaatgcctaccgctaattcgctcattttgaattaaggtcctttcatcatgcaaatttggggaacatcaaagaggcaaagactagggaccactatttcatacagttcccctcatggtctgagaatatgctggga

SEQ ID NO: 6759 - DNA, 389 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatggctcattttgaattaaggtcctttcgtcatgcaaatttggggaacatcaaagagacaaagactagggaccactatttctacagttcccctcatggtctgagaatatgctggga

SEQ ID NO: 6760 - DNA, 447 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgcatcttgactaccggtaatgcctacccgctgcttttcgctcattttgaattaaggtcctttcatcatgcaaatttgggaacatcaaagagacaaagactagggaccaccatttcatacagatcccctgtggtctgagaatatgctggga

SEQ ID NO: 6761 - DNA, 445 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagatttgactaccggtaatgcctacccgctaatttcgctcattttgaattaaggtcctttcatcatgcaaatttggggaacatcaaaagaggcaaagactagggaccactatttcatacagttcccctcatggtctgagaatatgctggga

SEQ ID NO: 6762 - DNA, 328 bp, Artificial; identical to SEQ ID NO: 6144
  TaSBEIIa  allele with mutations introduced by TALEN pair TaSBEIIa_T01

SEQ ID NO: 6763 - DNA, 430 bp, Artificial; identical to SEQ ID NO: 6337
  TaSBEIIa  allele with mutations introduced by TALEN pair TaSBEIIa_T01

SEQ ID NO: 6764 - DNA, 440 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatacatcttgactaccggtaatgcctacccgctgctttcgctcattttgaattaaggtcctttcatcatgcaaattttggggaacagtcaaagagacaaagactagggaccaccatttcatacagatcccctcgtggtctgagaatatgctggga

SEQ ID NO: 6765 - DNA, 433 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6766 - DNA, 448 bp, Artificial
  TaSBEIIa  allele with mutations introduced by TALEN pair TaSBEIIa_T01
  misc_feature (426): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagatccatcttgactaccggtaatgccctacccgctactttcgctcattttgaattaaggtcctttcgtcatgcaaatttggggaacatcaaagagacaaagactagggaccactatttcttacagttccccctnatggtctgagaatatgctggga

SEQ ID NO: 6767 - DNA, 455 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 6768 - DNA, 447 bp, Artificial
  TaSBEIIa  allele with mutations introduced by TALEN pair TaSBEIIa_T01
tcagatggatgtgcattctagcaagaacttcacgaaataatgcactgtttgtggtttcgtttgtctgctctacgattgctatttttcgtgtgctgtagatacctgaagatatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6769 - DNA, 353 bp, Artificial; identical to SEQ ID NO: 6654
  TaSBEIIa  allele with mutations introduced by TALEN pair TaSBEIIa_T01

SEQ ID NO: 6770 - DNA, 455 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6771 - DNA, 447 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaaccaggagatgggcagaaaatatacgagattgaccttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6772 - DNA, 343 bp, Artificial; identical to SEQ ID NO: 6125
  TaSBEIIa  allele with mutations introduced by TALEN pair TaSBEIIa_T01

SEQ ID NO: 6773 - DNA, 463 bp, Artificial; identical to SEQ ID NO: 6333
  TaSBEIIa  allele with mutations introduced by TALEN pair TaSBEIIa_T01

SEQ ID NO: 6774 - DNA, 439 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgactaccggtaatgcctacccgctgctttcgctcattttgaattaaggtcctttcatcatgcaaatttgggaacatcaaagagacaaagactagggaccaccatttcatacagatcccctgtggtctgagaatatgctggga

SEQ ID NO: 6775 - DNA, 442 bp, Artificial
  TaSBEIIa  allele with mutations introduced by TALEN pair TaSBEIIa_T01
tcagatggatgtgcattcttgcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctgctttcgctcattttgaattaaggtcctttcatcatgcaaatttgggaacatcaaagagacaaagactaggaccaccatttcatacagatccctcgtggtctgagaatatgctggga

SEQ ID NO: 6776 - DNA, 442 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgct

SEQ ID NO: 6777 - DNA, 409 bp, Artificial; identical to SEQ ID NO: 6460
  TaSBEIIa  allele with mutations introduced by TALEN pair TaSBEIIa_T01

SEQ ID NO: 6778 - DNA, 455 bp, Artificial; identical to SEQ ID NO: 6510
  TaSBEIIa  allele with mutations introduced by TALEN pair TaSBEIIa_T01

SEQ ID NO: 6779 - DNA, 448 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgcatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 6780 - DNA, 438 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatataatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6781 - DNA, 393 bp, Artificial; identical to SEQ ID NO: 6210
  TaSBEIIa  allele with mutations introduced by TALEN pair TaSBEIIa_T01

SEQ ID NO: 6782 - DNA, 362 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgctcatttgaattaaggtcctttcgtcatgcaaatttggggaacatcaaagagacaaagactagggaccactattcttacagttccctcatggtctgagaatatgctggga

SEQ ID NO: 6783 - DNA, 415 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 6784 - DNA, 436 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagctaccggtaatgcctacccgctgctttcgctcattttgaattaaggtcctttcatcatgcaaatttgggaacatcaaagagacaaagactagggaccaccatttcatacagactcccctcgtggtctgagaatatgctggga

SEQ ID NO: 6785 - DNA, 414 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatacccgctactttcgctcattttgaattaaggtcctttcgtcatgcaaattttggggaacatcaaagagacaaagactagggaccactatttcttacagttcccctcatggtctgagaatatgctggga

SEQ ID NO: 6786 - DNA, 449 bp, Artificial; identical to SEQ ID NO: 6275
  TaSBEIIa  allele with mutations introduced by TALEN pair TaSBEIIa_T01

SEQ ID NO: 6787 - DNA, 430 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6788 - DNA, 448 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 6789 - DNA, 328 bp, Artificial; identical to SEQ ID NO: 6144
  TaSBEIIa  allele with mutations introduced by TALEN pair TaSBEIIa_T01

SEQ ID NO: 6790 - DNA, 453 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctaccgctgctttcgctcattttgaattaaggtcctttcatcatgcaaatttgggaacatcaaagagacaaagactagggaccaccatttcatacagatcccctcgtggtctgagaatatgctggga

SEQ ID NO: 6791 - DNA, 432 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6792 - DNA, 378 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgaattaaggtcctttcgtcatgcaaatttggggaacatcaaagagacaagactaggaccactatttcttacagttcccctcatggtctgagaatatgctggga

SEQ ID NO: 6793 - DNA, 343 bp, Artificial; identical to SEQ ID NO: 6125
  TaSBEIIa  allele with mutations introduced by TALEN pair TaSBEIIa_T01

SEQ ID NO: 6794 - DNA, 456 bp, Artificial; identical to SEQ ID NO: 6380
  TaSBEIIa  allele with mutations introduced by TALEN pair TaSBEIIa_T01

SEQ ID NO: 6795 - DNA, 463 bp, Artificial; identical to SEQ ID NO: 6333
  TaSBEIIa  allele with mutations introduced by TALEN pair TaSBEIIa_T01

SEQ ID NO: 6796 - DNA, 420 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaatatacgcctacccgctgctttcgctcattttgaattaaggtcctttcatcatgcaaatttggggaacatcaaagagacaaagactagggaccaccatttcatacagatcccctcgtggtctgagatatgctggga

SEQ ID NO: 6797 - DNA, 446 bp, Artificial
  TaSBEIIa  allele with mutations introduced by TALEN pair TaSBEIIa_T01
  misc_feature (425): n is a or c or t or g
tcagatggatgtgcattactagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccttgactaccggtaatgcctacccgctactttcgctcattttgaattaaggtcctttcgtctatgcaaatttggggaacatcaaagagacaaagactagggaccactatttctacagttcccctnatggctgagaatatgctggga

SEQ ID NO: 6798 - DNA, 439 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 6799 - DNA, 443 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattcttgactaccggtaatgcctacccgctgctttcgctcattttgaattaggtcctttcatcatgcaaatttgggaacatcaaagagacaaagactagggaccaccatttcatacagatcccctcgtggtctgagaatactgctggga

SEQ ID NO: 6800 - DNA, 436 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagctaccggtaatgcctacccgctgctttcgctcattttgaattaaggtccttttcatcatgcaaatttggggaacatcaaagagacaaagactagggaccaccatttcatacagatcccctcgtggtctgagatatgctggga

SEQ ID NO: 6801 - DNA, 363 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttgggaacatcaaagagacaaagactagggaccactatttctacagttccctcatggtctgagaatatgctggga

SEQ ID NO: 6802 - DNA, 453 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccatcttgactaccggtaatgcctaccgctactttcgctcattttgaattaaggtcctttcgtcatgcaaatttggggaacatcaaagagacaaagactagggaccactattcttacagttccctcatggtctgagaatatgctggga

SEQ ID NO: 6803 - DNA, 444 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6804 - DNA, 430 bp, Artificial; identical to SEQ ID NO: 6337
  TaSBEIIa  allele with mutations introduced by TALEN pair TaSBEIIa_T01

SEQ ID NO: 6805 - DNA, 466 bp, Artificial
  TaSBEIIa  allele with mutations introduced by TALEN pair TaSBEIIa_T01
  misc_feature (377): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgaaagccatcttgactaccggtaatgcctacccgctaatttcgctcattttgaattaaggtcctttnatcatgcaaatttggggaacatcaaagaggcaaagactagggaccactatttcatacagttcccctcatggtctgagaatatgctggga

SEQ ID NO: 6806 - DNA, 457 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccatcttgactaccggtaatgcctacccgctactttcgctcattttgaatttaaggtcctttcgtcatgcaaatttggggaacatcaaagagacaaagactagggaccactatttcttacagttcccctcatggtctgagaatatgctggga

SEQ ID NO: 6807 - DNA, 456 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6808 - DNA, 452 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctacccgctgctttcgctcattttgaattaaggtcctttcatcatgcaaatttgggaacatcaaagagacaaagactagggaccaccatttcatacagatccctcgtggtctgagatatgctggga

SEQ ID NO: 6809 - DNA, 451 bp, Artificial; identical to SEQ ID NO: 6403
  TaSBEIIa  allele with mutations introduced by TALEN pair TaSBEIIa_T01

SEQ ID NO: 6810 - DNA, 408 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatctccagaaccgactcagggcattgtggaaacaatcactgatggtgtaaccaaaggagttaaggaactagtcgtgggggagaaaccgcgagttgtcccaaaaccaggagatgggcagacccgctgctttcgctcattttgaattaaggtcctttcatcatgcaaatttggggaacatcaaagagacaaagactagggaccaccatttcatacagatccctcgtggtctgagaatatgctggga

SEQ ID NO: 6811 - DNA, 445 bp, Artificial
  TaSBEIIa  allele with mutations introduced by TALEN pair TaSBEIIa_T01
  misc_feature (267): n is a or c or t or g
tcagatggatggcattctagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccnggagatgggcagaaaatatacgagattgaccttgactaccggtaatgcctacccgctactttcgctcattttgaattaaggtcctttcgtcatgcaaatttggggaacatcaaagagaccaaagactagggaccactatttcttacagttcccctcatggtctgagaatatgctggga

SEQ ID NO: 6812 - DNA, 398 bp, Artificial; identical to SEQ ID NO: 6466
  TaSBEIIa  allele with mutations introduced by TALEN pair TaSBEIIa_T01

SEQ ID NO: 6813 - DNA, 443 bp, Artificial; identical to SEQ ID NO: 6428
  TaSBEIIa  allele with mutations introduced by TALEN pair TaSBEIIa_T01

SEQ ID NO: 6814 - DNA, 339 bp, Artificial; identical to SEQ ID NO: 6123
  TaSBEIIa  allele with mutations introduced by TALEN pair TaSBEIIa_T01

SEQ ID NO: 6815 - DNA, 438 bp, Artificial; identical to SEQ ID NO: 6780
  TaSBEIIa  allele with mutations introduced by TALEN pair TaSBEIIa_T01

SEQ ID NO: 6816 - DNA, 467 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctagaaagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6817 - DNA, 443 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 6818 - DNA, 453 bp, Artificial
  TaSBEIIa  allele with mutations introduced by TALEN pair TaSBEIIa_T01
tcagatggatgtgcattactagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6819 - DNA, 464 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaaagccatcttgactaccggtaatgccctaccgctactttcgctcattttgaattaaggtccttttcgtcatgcaaatttggggaacatcaaagagacaaagactagggaccactatttcttacagttcccctcatggtctgagaatatgctggga

SEQ ID NO: 6820 - DNA, 366 bp, Artificial
  TaSBEIIa  allele with mutations introduced by TALEN pair TaSBEIIa_T01
tcagatggatgtgcattcctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtacccgctgctttcgctcattttgaattaaggtcctttcatcatgcaaatttgggaacatcaaaagagacaaagactaggaccaccatttcatacagatcccctcgtggtctgagaatatgctggga

SEQ ID NO: 6821 - DNA, 458 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccggagccatcttgactaccggtaatgcctacccgctgctttcgctcattttgaattaaggtcctttcattcatgcaaatttggggaacatcaaagagacaaagactagggaccaccatttcatacagatcccctcgtggtctgagaatatgctggga

SEQ ID NO: 6822 - DNA, 450 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgccatcttgactaccggtaatgcctacccgctaatttcgctcattttgaatttaaggtcctttcatcatgcaaatttgggaacatcaaagaggcaaagactagggaccactatttcatacagttcccctcatggtctgagatatgctggga

SEQ ID NO: 6823 - DNA, 447 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacatcttgactaccggtaatgcctacccgctactttcgctcattttgaattaaggtcctttcgtcatgcaaatttggggaacatcaaagagacaaagactagggaccactatttcttacagttcccctcatggtctgagaatatgcggga

SEQ ID NO: 6824 - DNA, 466 bp, Artificial; identical to SEQ ID NO: 5277
  TaSBEIIa  allele with mutations introduced by TALEN pair TaSBEIIa_T01

SEQ ID NO: 6825 - DNA, 397 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaacctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6826 - DNA, 369 bp, Artificial; identical to SEQ ID NO: 6369
  TaSBEIIa  allele with mutations introduced by TALEN pair TaSBEIIa_T01

SEQ ID NO: 6827 - DNA, 446 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccagactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6828 - DNA, 428 bp, Artificial
  TaSBEIIa  allele with mutations introduced by TALEN pair TaSBEIIa_T01
tcagatggatgtgcattactagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6829 - DNA, 442 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6830 - DNA, 452 bp, Artificial
  TaSBEIIa  allele with mutations introduced by TALEN pair TaSBEIIa_T01
tcagatggatgtgcattcagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctaccgctgctttcgctcattttgaattaaggtcctttcatcatgcaaatttgggaacatcaaagagacaaagactagggaccaccatttcatacagatcccctcgtggtctgagaatatgctggga

SEQ ID NO: 6831 - DNA, 430 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccctacccgctactttcgctcatttttgaattaaggtcctttcgtcatgcaaatttggggaacatcaaagagacaaagactagggaccactatttcttacagttcccctcatggtctgagaatatgctggga

SEQ ID NO: 6832 - DNA, 441 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttgactaccggtaatgcctacccgctgctttcgctcattttgaattaaggtcctttcatcatgcaaatttggggaacatcaaagagacaaagactagggaccaccatttcatacagatcccctcgtggtctgagatatgctggga

SEQ ID NO: 6833 - DNA, 438 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6834 - DNA, 366 bp, Artificial; identical to SEQ ID NO: 6175
  TaSBEIIa  allele with mutations introduced by TALEN pair TaSBEIIa_T01

SEQ ID NO: 6835 - DNA, 455 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 6836 - DNA, 456 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 6837 - DNA, 393 bp, Artificial; identical to SEQ ID NO: 6210
  TaSBEIIa  allele with mutations introduced by TALEN pair TaSBEIIa_T01

SEQ ID NO: 6838 - DNA, 463 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaaagccatcttgactaccggtaatgcctacccgctactttcgctcattttgaattaaggtcctttcgtcatgcaaatttgggaacatcaaagagacaaagactagggaccactatttacttacagttcccctcatggtctgagaatatgctggga

SEQ ID NO: 6839 - DNA, 445 bp, Artificial; identical to SEQ ID NO: 6267
  TaSBEIIa  allele with mutations introduced by TALEN pair TaSBEIIa_T01

SEQ ID NO: 6840 - DNA, 458 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgactcggagccatcttgactaccggtaatgcctacccgctgcttttcgctcattttgaattaaggtcctttcatcatgcaaatttggggaacatcaaagagacaaagactagggaccaccatttcatacagatcccctcgtggtctgagaatatgctggga

SEQ ID NO: 6841 - DNA, 446 bp, Artificial
  TaSBEIIa  allele with mutations introduced by TALEN pair TaSBEIIa_T01
tcagatggatgtgcattctagcaagaacttcacaaaataatgcactgtttgtggtttcatttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6842 - DNA, 441 bp, Artificial; identical to SEQ ID NO: 6344
  TaSBEIIa  allele with mutations introduced by TALEN pair TaSBEIIa_T01

SEQ ID NO: 6843 - DNA, 424 bp, Artificial; identical to SEQ ID NO: 6190
  TaSBEIIa  allele with mutations introduced by TALEN pair TaSBEIIa_T01

SEQ ID NO: 6844 - DNA, 398 bp, Artificial; identical to SEQ ID NO: 6466
  TaSBEIIa  allele with mutations introduced by TALEN pair TaSBEIIa_T01

SEQ ID NO: 6845 - DNA, 455 bp, Artificial; identical to SEQ ID NO: 6447
  TaSBEIIa  allele with mutations introduced by TALEN pair TaSBEIIa_T01

SEQ ID NO: 6846 - DNA, 457 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccatcttgactaccggtaatgcctaccgctactttcgctcatttttgaatttaaggtcctttcgtcatgcaaatttggggaacatcaaagagacaaagactagggaccactatttcttacagttcccctcatggtctgagaatatgctggga

SEQ ID NO: 6847 - DNA, 442 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgacttagggcattgtggaaacaatcactgatggtgtaaccaaaggagttaaggaactagtcgtgggggagaaaccgcgagttgtcccaaaaccaggagatgggcagaaaatatacgagattttgactaccggtaatgcctacccgctgctttcgctcattttgaattaaggtcctttcatcatgcaaatttggggaacatcaaagagacaaagactagggaccaccatttcatacagatccctcgtggtctgagaatatgctggga

SEQ ID NO: 6848 - DNA, 355 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactgctttcgctcattttgaattaaggtcctttcatcatgcaaaatttggggaacatcaaagagaacaaagactagggaccaccatttcatacagatcccctcgtggtctgagaatatgctggga

SEQ ID NO: 6849 - DNA, 380 bp, Artificial; identical to SEQ ID NO: 6194
  TaSBEIIa  allele with mutations introduced by TALEN pair TaSBEIIa_T01

SEQ ID NO: 6850 - DNA, 455 bp, Artificial
  TaSBEIIa  allele with mutations introduced by TALEN pair TaSBEIIa_T01
  misc_feature (450): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccggagccatcttgactaccggtaatgcctacccgctgctttcgctcattttgaattaaggtcctttcatcatgcaaatttgggaacatcaaagagacaaagactagggaccaccattcatacagatcccctcgtggtctgagaatatgntggga

SEQ ID NO: 6851 - DNA, 415 bp, Artificial; identical to SEQ ID NO: 6286
  TaSBEIIa  allele with mutations introduced by TALEN pair TaSBEIIa_T01

SEQ ID NO: 6852 - DNA, 455 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcccatcttgactaccggtaatgcctaccgctactttcgctcattttgaattaaggtcctttcgtcatgcaaatttggggaacatcaaagagacaaagactaggggaccactatttctacagttccctcatggtctgagaatatgctggga

SEQ ID NO: 6853 - DNA, 428 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccctacccgctactttcgctcattttgaattaaggtccttttcgtcatgcaaatttggggaacatcaaagagacaaagactagggaccactatttctacagttccctcatggtctgagaatatgctggga

SEQ ID NO: 6854 - DNA, 462 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaaagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 6855 - DNA, 439 bp, Artificial
  TaSBEIIa  allele with mutations introduced by TALEN pair TaSBEIIa_T01
tcagatggatgtgcattctagcaagaacttcacaacataatgcaccgtttgggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6856 - DNA, 432 bp, Artificial
  TaSBEIIa  allele with mutations introduced by TALEN pair TaSBEIIa_T01
tcagatggatgtgacattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgggtaatgcctacccgctgcttttcgctcattttgaatttaaggtcctttcatcatgcaaatttggggaacatcaaagagacaaagactagggaccaccatttcatacagatccccctgtggtctgagaatatgctggga

SEQ ID NO: 6857 - DNA, 452 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtacccaaaaccaggagatgggcagaaaatatacgagattgacccaacgctgactaccggtaatgcctaccgctaatttcgctcattttgaattaaggcctttcatcatgcaaatttggggaacatcaaagaggcaaagactagggaccactattcatacagttaccctcatggtctgagaatatgctggga

SEQ ID NO: 6858 - DNA, 425 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6859 - DNA, 442 bp, Artificial; identical to SEQ ID NO: 6829
  TaSBEIIa  allele with mutations introduced by TALEN pair TaSBEIIa_T01

SEQ ID NO: 6860 - DNA, 427 bp, Artificial; identical to SEQ ID NO: 6312
  TaSBEIIa  allele with mutations introduced by TALEN pair TaSBEIIa_T01

SEQ ID NO: 6861 - DNA, 451 bp, Artificial; identical to SEQ ID NO: 6228
  TaSBEIIa  allele with mutations introduced by TALEN pair TaSBEIIa_T01

SEQ ID NO: 6862 - DNA, 427 bp, Artificial; identical to SEQ ID NO: 6346
  TaSBEIIa  allele with mutations introduced by TALEN pair TaSBEIIa_T01

SEQ ID NO: 6863 - DNA, 333 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggcaaagactagggaccactatttcatacagttcccctcatggtctgagaatatgctggga

SEQ ID NO: 6864 - DNA, 440 bp, Artificial
  TaSBEIIa  allele with mutations introduced by TALEN pair TaSBEIIa_T01
  misc_feature (381): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattcttgactaccggtaatgcctaccgctactttcgctcattttgaattaaggtcctttcgtcatgcaaatttggggaacatcaaagngacaaagactagggaccactattcttacagttccctcatggtctgagaatatgctggga

SEQ ID NO: 6865 - DNA, 451 bp, Artificial
  TaSBEIIa  allele with mutations introduced by TALEN pair TaSBEIIa_T01
tcagatgggtgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6866 - DNA, 452 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6867 - DNA, 427 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccctacccgctactttcgctcattttgaattaaggtcctttcgtcatgcaaatttggggaacatcaaagagacaaagactagggaccactatttcttacagttccctcatggtctgagatatgctggga

SEQ ID NO: 6868 - DNA, 468 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgaaagagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6869 - DNA, 393 bp, Artificial; identical to SEQ ID NO: 6210
  TaSBEIIa  allele with mutations introduced by TALEN pair TaSBEIIa_T01

SEQ ID NO: 6870 - DNA, 443 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgacttgactaccggtaatgcctacccgctactttcgctcattttgaattaaggtcctttcgtcatgcaaatttgggggaaacagtcaaaagagacaaagactagggaccactatttcttacagttcccctcatggtctgagaatatgctggga

SEQ ID NO: 6871 - DNA, 416 bp, Artificial; identical to SEQ ID NO: 6131
  TaSBEIIa  allele with mutations introduced by TALEN pair TaSBEIIa_T01

SEQ ID NO: 6872 - DNA, 450 bp, Artificial; identical to SEQ ID NO: 6343
  TaSBEIIa  allele with mutations introduced by TALEN pair TaSBEIIa_T01

SEQ ID NO: 6873 - DNA, 446 bp, Artificial; identical to SEQ ID NO: 6414
  TaSBEIIa  allele with mutations introduced by TALEN pair TaSBEIIa_T01

SEQ ID NO: 6874 - DNA, 337 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgaaggtcctttcatcatgcaaatttgggaacatcaaagagacaaagactagggaccaccatttcatacagatcccctcgtggtctgagaatatgctggga

SEQ ID NO: 6875 - DNA, 417 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagctactttcgctcattttgaattaaggtcctttacgtcatgcaaatttggggaacatacaaagagacaaagactagggaccactatttcttacagttcccctcatggtctgagaatatgctggga

SEQ ID NO: 6876 - DNA, 427 bp, Artificial; identical to SEQ ID NO: 6312
  TaSBEIIa  allele with mutations introduced by TALEN pair TaSBEIIa_T01

SEQ ID NO: 6877 - DNA, 365 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttggggaacatcaaagagacaaagactagggaccactatttctacagttcccctcatggtctgagaatatgctggga

SEQ ID NO: 6878 - DNA, 429 bp, Artificial; identical to SEQ ID NO: 6160
  TaSBEIIa  allele with mutations introduced by TALEN pair TaSBEIIa_T01

SEQ ID NO: 6879 - DNA, 438 bp, Artificial; identical to SEQ ID NO: 6681
  TaSBEIIa  allele with mutations introduced by TALEN pair TaSBEIIa_T01
  misc_feature (269): n is a or c or t or g

SEQ ID NO: 6880 - DNA, 467 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgaccaaagattttcggagccatcttgactaccggtaatgcctaccgctaatttcgctcattttgaattaaggtcctttcatcatgcaaatttggggaacatcaaagaggcaaagactagggaccactatttcatacagttcccctcatggtctgagaatatgctggga

SEQ ID NO: 6881 - DNA, 440 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattcttgactaccggtaatgcctacccgctactttcgctcattttgaattaaggtcctttcgtcatgcaaatttggggaacatcaaagagacaaagactagggaccactatttctacagttccctcatggtctgagatatgctggga

SEQ ID NO: 6882 - DNA, 452 bp, Artificial
  TaSBEIIa  allele with mutations introduced by TALEN pair TaSBEIIa_T01
tcagatggatgtgcattctagcaagaacttcacaacataatgcaccgtttgggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattagccatcttgactaccggtaatgcctacccgctgctttcgctcattttgaatttaaggtcctttcatcatgcaaatttggggaacatcaaagagacaaagactagggaccaccatttcatacagatcccctcgtggtctgagaatatgctggga

SEQ ID NO: 6883 - DNA, 364 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttgggaacatcaaagagacaaagactagggaccactattcttacagttcccctcatggtctgagaatatgctggga

SEQ ID NO: 6884 - DNA, 446 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaactaccggtaatgcctaccgctaatttcgctcattttgaattaaggtcctttcatcatgcaaatttgggaacatcaaagaggcaaagactagggaccactatttcatacagttcccctcatggtctgagaatatgctggga

SEQ ID NO: 6885 - DNA, 464 bp, Artificial; identical to SEQ ID NO: 5105
  TaSBEIIa  allele with mutations introduced by TALEN pair TaSBEIIa_T01

SEQ ID NO: 6886 - DNA, 341 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaatcatcatgcaaatttggggaacatcaaaagagacaaagactagggaccaccatttcatacagatcccctcgtggtctgagaatatgctggga

SEQ ID NO: 6887 - DNA, 447 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacccgctaatttcgctcattttgaattaaggtcctttcatcatgcaaatttggggaacatcaaagaggcaaagactagggaccactatttcatacagttcccctcatggtctgagaatatgctgggactagactgccaaggcacacaggggatagg

SEQ ID NO: 6888 - DNA, 423 bp, Artificial
  TaSBEIIa  allele with mutations introduced by TALEN pair TaSBEIIa_T01
  misc_feature (400): n is a or c or t or g
tcagatggatgtgcattctatcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacatgcctaccgctgctttcgctcattttgaattaaggtcctttcatcatgcaaatttggggaacatcaaagagacaaagactagggaccaccatttcatacagatccccncgtggtctgagaatatgctggga

SEQ ID NO: 6889 - DNA, 445 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattcttgactaccggtaatgcctacccgctactttcgctcattttgaattaaggtcctttcgtcatgcaaatttggggaacatcaaagagacaaagactagggaccactatttacttacagttacccctcatggtctgagaatatgctggga

SEQ ID NO: 6890 - DNA, 455 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccggagccatcttgactaccggtaatgcctacccgctgctttcgctcattttgaattaaggtcctttcatcatgcaaatttgggaacatcaaagagacaaagactagggaccacatttcatacagatcccctcgtggtctgagaatatgctggga

SEQ ID NO: 6891 - DNA, 426 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgcatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 6892 - DNA, 427 bp, Artificial; identical to SEQ ID NO: 6312
  TaSBEIIa  allele with mutations introduced by TALEN pair TaSBEIIa_T01

SEQ ID NO: 6893 - DNA, 368 bp, Artificial
  TaSBEIIa  allele with mutations introduced by TALEN pair TaSBEIIa_T01
tcagatggtatgtgacattctagcaagaacttcacaacagtaatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtacccgctgctttcgctcattttgaattaaggtcctttcatcatgcaaatttggggaacatcaaagagacaaagactagggaccaccatttcatacagatcccctgtggtctgagaatatgctggga

SEQ ID NO: 6894 - DNA, 464 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctcggagccatcttgactaccggtaatgcctacccgctactttcgctcattttgaattaaggtccttttcgtcattgcaaatttggggaacatcaaagagacaaagactagggaccactatttctacagttcccctcatggtctgagaatatgctggga

SEQ ID NO: 6895 - DNA, 317 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggacatcaaagaggcaaagactagggaccactatttcatacagttcccctcatggtctgagaatatgctggga

SEQ ID NO: 6896 - DNA, 427 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgcctacccgctactttcgctcattttgaattgaggtcctttcgtcatgcaaatttggggaacatcaaagagacaaagactagggaccactatttcttacagttcccctcatggtctgagaatatgctggga

SEQ ID NO: 6897 - DNA, 469 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatcaaagagacaaagactagggaccacatttcatacagactcccctgtggtctgagaatatgctggga

SEQ ID NO: 6898 - DNA, 428 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccctaccgctactttcgctcattttgaattaaggtcctttcgtcatgcaaatttggggaacatcaaagagacaaagactagggaccactatttcttacagttcccctcatggtctgagaatatgctggga

SEQ ID NO: 6899 - DNA, 416 bp, Artificial
  TaSBEIIa  allele with mutations introduced by TALEN pair TaSBEIIa_T01
  misc_feature (269); (394): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccnggagatgggcagaaaatatacgagatactttcgctcattttgaattaaggtcctttcgtcatgcaaattttggggaacatcaaagagacaaagactagggaccactatttcttacagttcccctnatggtctgagaatatgctggga

SEQ ID NO: 6900 - DNA, 434 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagctacggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6901 - DNA, 378 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcggcgggggagaaaccgcgagttgtacccaaaaccaaattaaggtcctttcatcatgcaaatttggggaacatcaaagaggcaaagactagggaccactatttcatacagttcccctcatggtctgagaatatgctggga

SEQ ID NO: 6902 - DNA, 429 bp, Artificial
  TaSBEIIa  allele with mutations introduced by TALEN pair TaSBEIIa_T01
  misc_feature (407): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccctacccgctactttcgctcattttgaattaaggtcctttcgtcatgcaaatttggggaacatcaaagagacaaagactagggaccactatttcttacagttcccctnatggtctgagaatatgctggga

SEQ ID NO: 6903 - DNA, 451 bp, Artificial; identical to SEQ ID NO: 6371
  TaSBEIIa  allele with mutations introduced by TALEN pair TaSBEIIa_T01

SEQ ID NO: 6904 - DNA, 429 bp, Artificial; identical to SEQ ID NO: 6582
  TaSBEIIa  allele with mutations introduced by TALEN pair TaSBEIIa_T01

SEQ ID NO: 6905 - DNA, 449 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaactgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6906 - DNA, 409 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatctgctttcgctcattttgaattaaggtcctttcatcatgcaaatttggggaacatcaaagagacaaagactagggaccaccatttcatacagatctcctcgtggtctgagaatatgctggga

SEQ ID NO: 6907 - DNA, 416 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagatttttcgctcattttgaattaaggtcctttcatcatgcaaatttgggaacatcaaagaggcaaagactagggaccactatttcatacagttcccctcatggtctgagaatatgctggga

SEQ ID NO: 6908 - DNA, 366 bp, Artificial; identical to SEQ ID NO: 6175
  TaSBEIIa  allele with mutations introduced by TALEN pair TaSBEIIa_T01

SEQ ID NO: 6909 - DNA, 415 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagctactttcgctcattttgaattaaggtcctttcgtcatgcaaatttggggaacatcaaagagacaaagactagggaccactatttcttacagttcccctcatggtctgagaatatgctggga

SEQ ID NO: 6910 - DNA, 459 bp, Artificial
  TaSBEIIa  allele with mutations introduced by TALEN pair TaSBEIIa_T01
  misc_feature (437): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcccatcttgactaccggtaatgcctacccgctacttttcgctcattttgaattaaggtcctttcgtcatgcaaatttggggaacatcaaagagacaaagactagggaccactatttcttacagttccccctnatgtctgagaatatgcgtggga

SEQ ID NO: 6911 - DNA, 364 bp, Artificial; identical to SEQ ID NO: 6677
  TaSBEIIa  allele with mutations introduced by TALEN pair TaSBEIIa_T01

SEQ ID NO: 6912 - DNA, 443 bp, Artificial; identical to SEQ ID NO: 6817
  TaSBEIIa  allele with mutations introduced by TALEN pair TaSBEIIa_T01

SEQ ID NO: 6913 - DNA, 440 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggggagaaaccgcgagttgtcccaaaaccaggagatgggcagaaaatatacgacttgactaccggtaatgcctacccgctactttcgctcattttgaattaaggtccttttcgtcatgcaaatttggggaacatcaaagagacaaagactagggacactatttcttacagttcccctcatggtctgagaatatgctggga

SEQ ID NO: 6914 - DNA, 427 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6915 - DNA, 430 bp, Artificial; identical to SEQ ID NO: 6416
  TaSBEIIa  allele with mutations introduced by TALEN pair TaSBEIIa_T01

SEQ ID NO: 6916 - DNA, 379 bp, Artificial; identical to SEQ ID NO: 6289
  TaSBEIIa  allele with mutations introduced by TALEN pair TaSBEIIa_T01

SEQ ID NO: 6917 - DNA, 457 bp, Artificial
  TaSBEIIa  allele with mutations introduced by TALEN pair TaSBEIIa_T01
tctgatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgattttcggagccatcttgactaccggtaatgcctacccgctgctttcgctcattttgaattaaggtcctttcatcatgcaatttgggaacatcaaagagacaaagactagggaccaccatttcatacagatcccctcgtggtctgagaatatgctggga

SEQ ID NO: 6918 - DNA, 458 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccggagccatcttgactaccggtaatgcctacccgctgctttcgctcattttgaattaaggtccttttcatcatgcaaatttggggaacatcaaagagacaaagactagggaccaccatttcatacagatcccctcgtggtctgagaatatgctggga

SEQ ID NO: 6919 - DNA, 377 bp, Artificial; identical to SEQ ID NO: 6683
  TaSBEIIa  allele with mutations introduced by TALEN pair TaSBEIIa_T01

SEQ ID NO: 6920 - DNA, 461 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 6921 - DNA, 447 bp, Artificial
  TaSBEIIa  allele with mutations introduced by TALEN pair TaSBEIIa_T01
tcagatggatgtgcattctagcaagaacttcacaaaataatgcgactgtttgtggtttcgtttgtctgctctacgattgctattttcgtgtgctgtagatacctgaagatatcgaggagcaaacggctgaagtgaacatgacaggggggaccgcagagaaactttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattcttgactaccggtaatgcctaccgctaatttcgctcattttgaattaaggtcctttcatcatgcaaatttggggaacatcaaagaggcaaagactaggggaccactatttcatacagttcccctcatggtctgagaatatgctggga

SEQ ID NO: 6922 - DNA, 439 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 6923 - DNA, 397 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaacctacccgctgctttcgctcattttgaattaaggtcctttcatcatgcaaatttggggaacatcaaagagacaaagactagggaccaccatttcatacagatcccctcgtggtctgagaatatgctgggga

SEQ ID NO: 6924 - DNA, 463 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 6925 - DNA, 471 bp, Artificial; identical to SEQ ID NO: 5863
  TaSBEIIa  allele with mutations introduced by TALEN pair TaSBEIIa_T01

SEQ ID NO: 6926 - DNA, 445 bp, Artificial
  TaSBEIIa  allele with mutations introduced by TALEN pair TaSBEIIa_T01
  misc_feature (423): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagagccatcttgactaccggtaatgcctacccgctactttcgctcattttcgaattaaggtcctttcgtcatgcaaatttggggaacatcaaagagacaaagactagggaccactattctacagttcccctnatggtctgagaatatgctggga

SEQ ID NO: 6927 - DNA, 449 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccccatcttgactaccggtaatgcctacccgctactttcgctcattttgaattaaggtcctttcgtcatgcaaatttggggaacatcaaagagacaaagactagggaccactattcttacagttcccctcatggtctgagaatatgctgga

SEQ ID NO: 6928 - DNA, 400 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactaggtcgtgggggagaaaccgcgagttgtcccaaaaccaggagatgggctgctttcgctcattttgaattaaggtcctttcatcatgacaaatttggggaacatcaaagagacaaagactaggaccaccattcatacagatccctcgtggtctgagaatatgctggga

SEQ ID NO: 6929 - DNA, 437 bp, Artificial; identical to SEQ ID NO: 6682
  TaSBEIIa  allele with mutations introduced by TALEN pair TaSBEIIa_T01

SEQ ID NO: 6930 - DNA, 441 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6931 - DNA, 423 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6932 - DNA, 438 bp, Artificial; identical to SEQ ID NO: 6833
  TaSBEIIa  allele with mutations introduced by TALEN pair TaSBEIIa_T01

SEQ ID NO: 6933 - DNA, 428 bp, Artificial; identical to SEQ ID NO: 6898
  TaSBEIIa  allele with mutations introduced by TALEN pair TaSBEIIa_T01

SEQ ID NO: 6934 - DNA, 436 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccggtaatgcctacccgctactttcgctcattttgaattaaggtcctttcgtcatgcaaatttggggaacatcaaagagacaaagactagggaccatatttcttacagttcccctcatggtctgagaatatgctggga

SEQ ID NO: 6935 - DNA, 452 bp, Artificial; identical to SEQ ID NO: 6866
  TaSBEIIa  allele with mutations introduced by TALEN pair TaSBEIIa_T01

SEQ ID NO: 6936 - DNA, 438 bp, Artificial; identical to SEQ ID NO: 6833
  TaSBEIIa  allele with mutations introduced by TALEN pair TaSBEIIa_T01

SEQ ID NO: 6937 - DNA, 458 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6938 - DNA, 453 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctacccgctgctttcgctcattttgaattaaggtcctttcatcatgcaaatttgggaacatcaaagagacaaagactagggaccaccatttcatacagatcccctgtggtctgagaatatgctggga

SEQ ID NO: 6939 - DNA, 339 bp, Artificial; identical to SEQ ID NO: 6123
  TaSBEIIa  allele with mutations introduced by TALEN pair TaSBEIIa_T01

SEQ ID NO: 6940 - DNA, 374 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6941 - DNA, 453 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcatcttgactaccggtaatgcctaccgctactttcgctcattttgaattaaggtcctttcgtcatgcaaatttggggaacatcaaagagacaaagactagggaccactatttctacagttcccctcatggtctgagaatatgctggga

SEQ ID NO: 6942 - DNA, 392 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagactttcgctcattttgaattaaggtccttcgtcatgcaaatttggggaacatcaaagagacaaagactagggaccactatttcttacagttcccctcatggtctgagaatatgctggga

SEQ ID NO: 6943 - DNA, 450 bp, Artificial; identical to SEQ ID NO: 6268
  TaSBEIIa  allele with mutations introduced by TALEN pair TaSBEIIa_T01

SEQ ID NO: 6944 - DNA, 417 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacccgctaatttcgctcattttgaattaaggtcctttcatcatgcaaatttggggaacatcaaagaggcaaaagctagggaccactatttcatacagttcccctcatggtctgagatatgctggga

SEQ ID NO: 6945 - DNA, 430 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6946 - DNA, 446 bp, Artificial; identical to SEQ ID NO: 6414
  TaSBEIIa  allele with mutations introduced by TALEN pair TaSBEIIa_T01

SEQ ID NO: 6947 - DNA, 427 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgggtaatgcctacccgctgctttcgctcattttgaattaaggtcctttcatcatgcaaatttgggaacatcaaagagacaaagactagggaccaccatttcatacagatcccctgtggtctgagaatatgctggga

SEQ ID NO: 6948 - DNA, 397 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaaccaggagactttcgctcattttagaattaaggtcctttcgtcatgcaaatttggggaacatcaaaagagacaaagactagggaccactatttcttacagttcccctcatggtctgagaatactgctggga

SEQ ID NO: 6949 - DNA, 368 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtggggagaaaccgcgagttcattttgaattaaggtcctttcatcatgcaaatttggggaacatcaaagagacaaagactagggaccaccatttcatacagatcccctcgtggtctgagaatatgctggga

SEQ ID NO: 6950 - DNA, 468 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtacgatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgaccaaagattttcggagccatcttgactaccggtaatgcctaccgctaatttcgctcattttgaattaaggtcctttcatcatgcaaatttggggaacatcaaagaggcaaagactagggaccactatttcatacagttcccctcatggtctgagaatatgctggga

SEQ ID NO: 6951 - DNA, 445 bp, Artificial; identical to SEQ ID NO: 6267
  TaSBEIIa  allele with mutations introduced by TALEN pair TaSBEIIa_T01

SEQ ID NO: 6952 - DNA, 448 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctatttttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgcatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6953 - DNA, 369 bp, Artificial; identical to SEQ ID NO: 6369
  TaSBEIIa  allele with mutations introduced by TALEN pair TaSBEIIa_T01

SEQ ID NO: 6954 - DNA, 462 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6955 - DNA, 454 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccatcttgactaccggtaatgcctaccgctactttcgctcattttgaattaaggtcctttcgtcatgcaaatttggggaacatcaaagagacaaagactagggaccactatttctacagttcccctcatggtctgagaatatgctggga

SEQ ID NO: 6956 - DNA, 416 bp, Artificial; identical to SEQ ID NO: 6131
  TaSBEIIa  allele with mutations introduced by TALEN pair TaSBEIIa_T01

SEQ ID NO: 6957 - DNA, 426 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacatgcctacccgctgctttcgctcattttgaattaaggtcctttcatcatgcaaatttggggaacatcaaagagacaaagactagggaccaccatttcatacagatcccctcgtggtctggagaatatgcgtggga

SEQ ID NO: 6958 - DNA, 453 bp, Artificial; identical to SEQ ID NO: 6790
  TaSBEIIa  allele with mutations introduced by TALEN pair TaSBEIIa_T01

SEQ ID NO: 6959 - DNA, 446 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattcatcttgactaccggtaatgcctacccgctgctttcgctcattttgaattaaggtcctttcatcatgcaaatttggggaacatcaaagagacaaagactagggaccaccatttcatacagatccctcgtggtctgagaatatgctggga

SEQ ID NO: 6960 - DNA, 404 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatttcgctcattttgaattaaggtcctttcgtcatgcaaatttggggaacatcaaagagacaaagactagggaccactatttctacagttcccctcatggtctgagaatatgctggga

SEQ ID NO: 6961 - DNA, 449 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaaacaatcactgatggtgtaaccaaaggagttaaggaactagtcgtgggggagaaaccgcgagttgtcccaaaaccaggagatgggcagaaaatatacgagattgacccaactgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 6962 - DNA, 430 bp, Artificial; identical to SEQ ID NO: 6337
  TaSBEIIa  allele with mutations introduced by TALEN pair TaSBEIIa_T01

SEQ ID NO: 6963 - DNA, 427 bp, Artificial
  TaSBEIIa  allele with mutations introduced by TALEN pair TaSBEIIa_T01
tcagatggatgtgcattactagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacatgcctacccgctgctttacgctcattttgaattaaggtcctttcatcgatgcaaatttggggaacatcaaagagacaaagactagggaccaccatttcatacagatcccctcgtggtctgagaatatgctggga

SEQ ID NO: 6964 - DNA, 418 bp, Artificial; identical to SEQ ID NO: 6375
  TaSBEIIa  allele with mutations introduced by TALEN pair TaSBEIIa_T01

SEQ ID NO: 6965 - DNA, 443 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacatcttgactaccggtaatgcctacccgctaatttcgctcattttgaattaaggtcctttcatcatgcaaatttggggaacatcaaagaggcaaagactagggaccactatttcatacagttccccctcatggtctgagaatatgctggga

SEQ ID NO: 6966 - DNA, 451 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctaccgctgctttcgctcattttgaattaaggtcctttacatcatgcaaatttggggaacatcaaagagacaaagactagggaccaccatttcatacagatcccctcgtggtctgagaatatgctggga

SEQ ID NO: 6967 - DNA, 454 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 6968 - DNA, 437 bp, Artificial; identical to SEQ ID NO: 6682
  TaSBEIIa  allele with mutations introduced by TALEN pair TaSBEIIa_T01

SEQ ID NO: 6969 - DNA, 430 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatggccatcttgactaccggtaatgcctacccgctgctttcgctcattttgaattaaggtcctttcatcatgcaaatttggggaacatcaaagagaacaaagactagggaccaccatttcatacagatcccctcgtggtctgagaatatgctggga

SEQ ID NO: 6970 - DNA, 444 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctactttcgctcattttgaattaaggtcctttcgtcatgcaaatttggggaacatcaaagagacaaagactaggaccgactatttcttacagttcccctcatggtctgagaatatgctggga

SEQ ID NO: 6971 - DNA, 462 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 6972 - DNA, 453 bp, Artificial; identical to SEQ ID NO: 6432
  TaSBEIIa  allele with mutations introduced by TALEN pair TaSBEIIa_T01

SEQ ID NO: 6973 - DNA, 395 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgctttcgctcattttgaattaaggtcctttcatcatgcaaatttggggaacatcaaagagacaaagactagggaccaccatttcatacagatcccctgtggtctgagaatatgctggga

SEQ ID NO: 6974 - DNA, 420 bp, Artificial; identical to SEQ ID NO: 6278
  TaSBEIIa  allele with mutations introduced by TALEN pair TaSBEIIa_T01

SEQ ID NO: 6975 - DNA, 441 bp, Artificial
  TaSBEIIa  allele with mutations introduced by TALEN pair TaSBEIIa_T01
  misc_feature (418): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgactaccggtaatgcctacccgctactttcgctcattttgaattaaggtcctttcgtcatgcaaatttggggaacatcaaagagacaaagactagggaccactatttcttacagttcccctnactggtctgagaatatgctggga

SEQ ID NO: 6976 - DNA, 456 bp, Artificial; identical to SEQ ID NO: 6807
  TaSBEIIa  allele with mutations introduced by TALEN pair TaSBEIIa_T01

SEQ ID NO: 6977 - DNA, 335 bp, Artificial; identical to SEQ ID NO: 6166
  TaSBEIIa  allele with mutations introduced by TALEN pair TaSBEIIa_T01

SEQ ID NO: 6978 - DNA, 463 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaaccaggagatgggcagaaaatatacgagattgacccaacactgaaagccatcttgactaccggtaatgcctacccgctgctttcgctcatttgaattaaggtcctttcatcatgcaaatttggggaacatcaaagagacaaagactagggaccaccatttcatacagatcccctcgtgtctgagaatatgctggga

SEQ ID NO: 6979 - DNA, 334 bp, Artificial
  TaSBEIIa  allele with mutations introduced by TALEN pair TaSBEIIa_T01
  misc_feature (246): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtggggganaaaccgcgaatttggggaacatcaaagagacaaagactagggaccaccatttcatacagatcccctgtggtctgagaatatgctggga

SEQ ID NO: 6980 - DNA, 437 bp, Artificial; identical to SEQ ID NO: 6682
  TaSBEIIa  allele with mutations introduced by TALEN pair TaSBEIIa_T01

SEQ ID NO: 6981 - DNA, 444 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcaagaaaatatacgagattcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6982 - DNA, 456 bp, Artificial; identical to SEQ ID NO: 6380
  TaSBEIIa  allele with mutations introduced by TALEN pair TaSBEIIa_T01

SEQ ID NO: 6983 - DNA, 445 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagatccatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 6984 - DNA, 407 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaactaccggtaatgcctacccgctactttcgctcattttgaattaaggtcctttcgtcatacaaatttggggaacatcaaagagacaaagactagggaccactatttcttacagttcccctcatggtctgagaatatgctggga

SEQ ID NO: 6985 - DNA, 414 bp, Artificial; identical to SEQ ID NO: 6565
  TaSBEIIa  allele with mutations introduced by TALEN pair TaSBEIIa_T01

SEQ ID NO: 6986 - DNA, 436 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatggtcggagccatcttgactaccggtaatgcctacccgctaatttcgctcattttgaattaaggtcctttcatcatgcaaatttggggaacatcaaagaggcaaagactagggaccactatttcatacagttcccctcatggtctgagatatgctggga

SEQ ID NO: 6987 - DNA, 430 bp, Artificial; identical to SEQ ID NO: 6337
  TaSBEIIa  allele with mutations introduced by TALEN pair TaSBEIIa_T01

SEQ ID NO: 6988 - DNA, 455 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 6989 - DNA, 446 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagataattcgctcattttgaattaaggtcctttcatcatgcaaatttggggaacatcaaagaggcaaagactagggaccactatttcatacagttcccctcatggtctgagaatatgctgggactgaactgccaaggcacacaggggatagg

SEQ ID NO: 6990 - DNA, 403 bp, Artificial; identical to SEQ ID NO: 6402
  TaSBEIIa  allele with mutations introduced by TALEN pair TaSBEIIa_T01

SEQ ID NO: 6991 - DNA, 450 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 6992 - DNA, 448 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 6993 - DNA, 463 bp, Artificial
  TaSBEIIa  allele with mutations introduced by TALEN pair TaSBEIIa_T01
  misc_feature (245): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggganaaaccgcgagttgtcccaaaaccaggagatgggcagaaaatatacgagattgacccaacgctcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6994 - DNA, 443 bp, Artificial
  TaSBEIIa  allele with mutations introduced by TALEN pair TaSBEIIa_T01
tcagtggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 6995 - DNA, 449 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 6996 - DNA, 427 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtccaaaaccaggagatgggcagaaaatatacgggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 6997 - DNA, 458 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccggagccatcttgactaccggtaatgcctaccgctgctttcgctcattttgaattaaggtccttttcatcatgcaaatttgggaacatcaaagagacaaagactagggaccaccatttcatacagactcccctcgtggtctgagaatatgctggga

SEQ ID NO: 6998 - DNA, 352 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactgctttcgctcattttgaattaaggtcctttcatcatgcaaatttggggaacatcaaagagacaaagactagggaccaccatttcatacagatcccctgtggtctgagaatatgctggga

SEQ ID NO: 6999 - DNA, 454 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttttcggagccatcttgactaccggtaatgcctacccgctgctttcgctcattttgaattaaggtcctttcatcatgcaaatttgggaacatcaaagagacaaagactagggaccaccattcatacagactccctcgtggtctgagaatatgctggga

SEQ ID NO: 7000 - DNA, 452 bp, Artificial; identical to SEQ ID NO: 6453
  TaSBEIIa  allele with mutations introduced by TALEN pair TaSBEIIa_T01

SEQ ID NO: 7001 - DNA, 421 bp, Artificial
  TaSBEIIa  allele with mutations introduced by TALEN pair TaSBEIIa_T01
tcagatggatgtgcattctagcaagaacttcacaacataatgcaccgtttgaggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacctacccgctgctttcgctcattttgaattaaggtcctttcatcatgcaaatttggggaacatcaaaagagacaaagactagggaccaccatttcatacagatcccctcgtggtctgagaatatgctggga

SEQ ID NO: 7002 - DNA, 446 bp, Artificial
  TaSBEIIa  allele with mutations introduced by TALEN pair TaSBEIIa_T01
  misc_feature (424): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgcatcttgactaccggtaatgcctacccgctactttcgctcattttgaattaaggtcctttcgtcatgcaaatttgggaacatcaaagagacaaagactagggaccactatttcttacagttcccctnatggtctgagaatatgctggga

SEQ ID NO: 7003 - DNA, 420 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaaccaaaggagttaaggaactagtcgtgggggagaaaccgcgagttgtcccaaaaccaggagatgggcagaaaatatacctacccgctgctttcgctcattttgaattaaggtcctttcatcatgcaaatttggggaacatcaaagagacaaagactagggaccaccatttcatacagatccctcgtggtctgagaatatgctggga

SEQ ID NO: 7004 - DNA, 450 bp, Artificial
  TaSBEIIa  allele with mutations introduced by TALEN pair TaSBEIIa_T01
tcagatgatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7005 - DNA, 444 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatcatcttgactaccggtaatgcctacccgctgctttcgctcattttgaattaaggtcctttcatcatgcaaatttggggaacatcaaagagacaaagactagggaccacattcatacagatcccctcgtggtctgagaatatgctggga

SEQ ID NO: 7006 - DNA, 441 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7007 - DNA, 458 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgccatcttgactaccggtaatgcctacccgctaatttcgctcattttgaattaaggtcctttcatcatgcaaatttggggaacatcaaagaggcaaagactagggaccactatttcatacagttcccctcatggtctgagatatgctggga

SEQ ID NO: 7008 - DNA, 350 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagtcctttcgtcatgcaaatttggggaacatcaaagagacaaagactagggaccactattcttacagttcccctcatggtctgagaatatgctggga

SEQ ID NO: 7009 - DNA, 405 bp, Artificial
  TaSBEIIa  allele with mutations introduced by TALEN pair TaSBEIIa_T01
  misc_feature (383): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatttcgctcattttgaattaaggtcctttcgtcatgcaaatttggggaacatcaaagagacaaagactagggaccactatttcttacagttcccctnatggtctgagaatatgctggga

SEQ ID NO: 7010 - DNA, 455 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaaccaaaggagttaaggaactagtcgtgggggagaaaccgcgagttgtcccaaaaccaggagatgggcagaaaatatacgagatttttcggagccatcttgactaccggtaatgcctacccgctgctttcgctcattttgaattaaggtcctttcatcatgcaaatttgggaacatcaaagagacaaagactagggaccaccatttcatacagatcccctgtggtctgagaatatgctggga

SEQ ID NO: 7011 - DNA, 427 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgcctacccgctaatttcgctcattttgaattaaggtcctttcatcatgcaaatttgggaacatcaaagaggcaaagactagggaccactatttcatacagttcccctcatggtctgagatatgctggga

SEQ ID NO: 7012 - DNA, 450 bp, Artificial; identical to SEQ ID NO: 6343
  TaSBEIIa  allele with mutations introduced by TALEN pair TaSBEIIa_T01

SEQ ID NO: 7013 - DNA, 369 bp, Artificial; identical to SEQ ID NO: 6369
  TaSBEIIa  allele with mutations introduced by TALEN pair TaSBEIIa_T01

SEQ ID NO: 7014 - DNA, 453 bp, Artificial
  TaSBEIIa  allele with mutations introduced by TALEN pair TaSBEIIa_T01
  misc_feature (430): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattcggagccatcttgactaccggtaatgcctacccgctactttcgctcattttgaattaaggtcctttcgtcatgcaaatttggggaacatcaaagagacaaagactagggaccactatttcttacagttcccctnatggtctgagaatatgcgtggga

SEQ ID NO: 7015 - DNA, 453 bp, Artificial
  TaSBEIIa  allele with mutations introduced by TALEN pair TaSBEIIa_T01
  misc_feature (394): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctacccgctgctttcgctcattttgaattaaggtcctttcatcatgcaaatttgggaacatcaaaganacaaagactagggaccaccatttcatacagatcccctgtggtctgagaatatgctggga

SEQ ID NO: 7016 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7017 - DNA, 442 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctatttttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgactaccggtaatgcctacccgctactttcgctcattttgaattaaggtcctttcgtcatgcaaatttggggaacatcaaagagaacaaagactagggaccactatttcttacagttcccctcatggtctgagaatatgctggga

SEQ ID NO: 7018 - DNA, 414 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattcgctcattttgaattaaggtcctttcatcatgcaaatttggggaacatcaaagaggcaaagactagggaccactatttcatacagttcccctcatggtctgagaatatgctggga

SEQ ID NO: 7019 - DNA, 417 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaatgcctacccgctaattcgctcattttgaattaaggtcctttcatcatgcaaatttggggaacatcaaagaggcaaagactagggaccactatttcatacagttcccctcatggtctgagaatatgctggga

SEQ ID NO: 7020 - DNA, 448 bp, Artificial; identical to SEQ ID NO: 6329
  TaSBEIIa  allele with mutations introduced by TALEN pair TaSBEIIa_T01

SEQ ID NO: 7021 - DNA, 450 bp, Artificial; identical to SEQ ID NO: 6343
  TaSBEIIa  allele with mutations introduced by TALEN pair TaSBEIIa_T01

SEQ ID NO: 7022 - DNA, 445 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccttgactaccggtaatgcctacccgctactttcgctcattttgaattaaggtccttcgtcatgcaaatttggggaacatcaaagagacaaagactagggaccactatttcttacagttcccctcatggtctgagaatatgctggga

SEQ ID NO: 7023 - DNA, 458 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgattttcggagccatcttgactaccggtaatgcctacccgctgctttcgctcattttgaattaaggtcctttcatcatgcaaatttggggaacatcaaagagacaaagactaggaccaccatttcatacagatcccctcgtggtctgagaatatgctggga

SEQ ID NO: 7024 - DNA, 463 bp, Artificial; identical to SEQ ID NO: 6333
  TaSBEIIa  allele with mutations introduced by TALEN pair TaSBEIIa_T01

SEQ ID NO: 7025 - DNA, 430 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccctacccgctacttttcgctcattttgaattaaggtcctttcgtcatgcaaatttggggaacatcaaagagacaaagactagggaccactatttcttacagttcccctcatggtctgagaatatgctggga

SEQ ID NO: 7026 - DNA, 430 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcaggactaccggtaatgcctacccgctaatttcgctcattttgaattaaggtcctttcatcatgcaaatttggggaacatcaaaagaggcaaaagactagggaccactatttcatacagttcccctcatggtctgagaatatgctggga

SEQ ID NO: 7027 - DNA, 380 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctatttttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcctttcgctcattttgaattaaggtcctttcgtcatgcaaatttggggaacatcaaagagacaaagactagggaccactatttcttacagttcccctcatggtctgagaatatgctggga

SEQ ID NO: 7028 - DNA, 438 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatacatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7029 - DNA, 454 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctacccgctgctttcgctctattttgaattaaggtcctttcatcatgcaaatttggggaacatcaaagagacaaagactaggaccaccattcatacagatcccctcgtggtctgagaatatgctggga

SEQ ID NO: 7030 - DNA, 440 bp, Artificial; identical to SEQ ID NO: 6178
  TaSBEIIa  allele with mutations introduced by TALEN pair TaSBEIIa_T01

SEQ ID NO: 7031 - DNA, 462 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatataacgagattgacccaacgctgaaagccatcttgactaccggtaatgcctacccgctactttcgctcattttgaattaaggtcctttcgtcatgcaaatttggggaacatcaaagagaacaaagactagggacactattcttacagttccctcatggtctgagaatatgctggga

SEQ ID NO: 7032 - DNA, 437 bp, Artificial; identical to SEQ ID NO: 6682
  TaSBEIIa  allele with mutations introduced by TALEN pair TaSBEIIa_T01

SEQ ID NO: 7033 - DNA, 339 bp, Artificial; identical to SEQ ID NO: 6123
  TaSBEIIa  allele with mutations introduced by TALEN pair TaSBEIIa_T01

SEQ ID NO: 7034 - DNA, 452 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcaggacattgtggaaacaatcactgatggtgtaaccaaaggagttaaggaactagtcgtgggggagaaaccgcgagttgtcccaaaaccaggagatgggcagaaaatatacgagattgaccccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7035 - DNA, 427 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccctaccgctacttcgctcattttgaattaaggtcctttcgtcatgcaaatttggggaacatcaaagagacaaagactagggaccactatttcttacagttcccctcatggtctgagaatatgctggga

SEQ ID NO: 7036 - DNA, 366 bp, Artificial; identical to SEQ ID NO: 6126
  TaSBEIIa  allele with mutations introduced by TALEN pair TaSBEIIa_T01

SEQ ID NO: 7037 - DNA, 448 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattcatcttgactaccggtaatgcctaccgctaatttcgctcattttgaattaaggtcctttcatcatgcaaatttggggaacatcaaagaggcaaagactagggaccactatttcatacagttcccctcatggtctgagaatatgctggga

SEQ ID NO: 7038 - DNA, 366 bp, Artificial; identical to SEQ ID NO: 6175
  TaSBEIIa  allele with mutations introduced by TALEN pair TaSBEIIa_T01

SEQ ID NO: 7039 - DNA, 368 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtacccgctgctttcgctcattttgaattaaggtcctttcatcatgcaaaatttggggaacatcaaaagagacaaagactagggaccaccatttcatacagatcccctcgtggtctgagaatatgctggga

SEQ ID NO: 7040 - DNA, 471 bp, Artificial; identical to SEQ ID NO: 5255
  TaSBEIIa  allele with mutations introduced by TALEN pair TaSBEIIa_T01

SEQ ID NO: 7041 - DNA, 457 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacattttcggagccatcttgactaccggtaatgcctacccgctgctttcgctcattttgaattaaggtccttcatcatgcaaatttgggaacatcaagagacaaagactagggaccacatttcatacagatcccctcgtggtctgagaatatgctggga

SEQ ID NO: 7042 - DNA, 455 bp, Artificial; identical to SEQ ID NO: 6447
  TaSBEIIa  allele with mutations introduced by TALEN pair TaSBEIIa_T01

SEQ ID NO: 7043 - DNA, 428 bp, Artificial; identical to SEQ ID NO: 6391
  TaSBEIIa  allele with mutations introduced by TALEN pair TaSBEIIa_T01

SEQ ID NO: 7044 - DNA, 423 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaaccaggagatggttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 7045 - DNA, 437 bp, Artificial; identical to SEQ ID NO: 6168
  TaSBEIIa  allele with mutations introduced by TALEN pair TaSBEIIa_T01

SEQ ID NO: 7046 - DNA, 420 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaggtaatgcctacccgctgctttcgctcaattttgaattaaggtcctttcatcatgcaaatttggggaacatcaaagagacaaagactagggaccaccatttcatacagatccctcgtggtctgagaatatgctggga

SEQ ID NO: 7047 - DNA, 436 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgacttgactaccggtaatgcctaccgctacttcgctcattttgaattaaggtcctttcgtcatgcaaatttggggaacatcaaagagacaaagactagggacactatttcttacagttcccctcatggtctgagaatatgctggga

SEQ ID NO: 7048 - DNA, 456 bp, Artificial; identical to SEQ ID NO: 6380
  TaSBEIIa  allele with mutations introduced by TALEN pair TaSBEIIa_T01

SEQ ID NO: 7049 - DNA, 449 bp, Artificial; identical to SEQ ID NO: 6275
  TaSBEIIa  allele with mutations introduced by TALEN pair TaSBEIIa_T01

SEQ ID NO: 7050 - DNA, 399 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgatttcgctcattttgaattaaggtcctttcatcatgcaaatttggggaacagtcaaagaggcaaagactagggaccactatttcatacagttcccctcatggtctgagaatatgctggga

SEQ ID NO: 7051 - DNA, 430 bp, Artificial
  TaSBEIIa  allele with mutations introduced by TALEN pair TaSBEIIa_T01
tcagatggatgtgcattctaacaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcaagaaaataccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7052 - DNA, 427 bp, Artificial; identical to SEQ ID NO: 6346
  TaSBEIIa  allele with mutations introduced by TALEN pair TaSBEIIa_T01

SEQ ID NO: 7053 - DNA, 448 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagccatcttgactaccggtaatgcctacccgctaatttcgctcattttgaattaaggtcctttcatcatgcaaatttggggaacatcaaagaggcaaagactaggggaccactatttcatacagttcccctcatggtctgagaatatgctggga

SEQ ID NO: 7054 - DNA, 450 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 7055 - DNA, 455 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaaccaaaggagttaaggaactagtcgcgggggagaaaccgcgagttgtcccaaaaccaggagatgggcagaaaatatacgagattgacccaacgctgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7056 - DNA, 452 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcatcttgactaccggtaatgcctaccgctacttcgctcattttgaattaaggtcctttcgtcatgcaaatttggggaacatcaaagagacaaagactagggaccactattcttacagttcccctcatggtctgagaatatgctggga

SEQ ID NO: 7057 - DNA, 436 bp, Artificial; identical to SEQ ID NO: 6302
  TaSBEIIa  allele with mutations introduced by TALEN pair TaSBEIIa_T01

SEQ ID NO: 7058 - DNA, 447 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaactgactaccggtaatgcctaccgctactttcgctcattttgaattaaggtcctttcgtcatgcaaatttggggaacatcaaagagacaaagactagggaccactattcttacagttcccctcatggtctgagaatatgctggga

SEQ ID NO: 7059 - DNA, 339 bp, Artificial
  TaSBEIIa  allele with mutations introduced by TALEN pair TaSBEIIa_T01
tcagatggatgtgcattctagcaagaacttcacaacataatgcaccgtttgggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaatcatcatgcaaatttggggaacatcaaagagacaaagactagggaccaccatttcatacagatcccctcgtggtctgagaatatgctggga

SEQ ID NO: 7060 - DNA, 429 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaaacaatcactgatggtgtaaccaaaggagttaaggaactagtcgtgggggagaaaccgcgagttgtcccaaaaccaggagatgggcagaaaatatacgagattgaccctacccgctactttcgctcattttgaattaaggtcctttcgtcatgcaaatttggggaacatcaaagagacaaagactagggaccactatttcttacagttcccctcatggtctgagatatgctggga

SEQ ID NO: 7061 - DNA, 366 bp, Artificial
  TaSBEIIa  allele with mutations introduced by TALEN pair TaSBEIIa_T01
tcagatggatgtgcattctagcaagaacttcacaacataatgcaccgtttgggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtacccgctgctttcgctcattttgaattaaggtcctttcatcatgcaaatttggggaacatcaaagagacaaagactagggaccaccatttcatacagatcccctgtggtctgagaatatgctggga

SEQ ID NO: 7062 - DNA, 447 bp, Artificial; identical to SEQ ID NO: 6589
  TaSBEIIa  allele with mutations introduced by TALEN pair TaSBEIIa_T01

SEQ ID NO: 7063 - DNA, 457 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaaccaggagatgggcagaaaatatacgagattgacccaacgcatcttgactaccggtaatgcctacccgctactttcgctcattttgaatttaaggtcctttcgtcatgcaaatttggggaacatcaaagagacaaagactagggaccactatttcttacagttcccctcatggtctgagaatatgctggga

SEQ ID NO: 7064 - DNA, 379 bp, Artificial; identical to SEQ ID NO: 6183
  TaSBEIIa  allele with mutations introduced by TALEN pair TaSBEIIa_T01

SEQ ID NO: 7065 - DNA, 416 bp, Artificial; identical to SEQ ID NO: 6131
  TaSBEIIa  allele with mutations introduced by TALEN pair TaSBEIIa_T01

SEQ ID NO: 7066 - DNA, 382 bp, Artificial; identical to SEQ ID NO: 6499
  TaSBEIIa  allele with mutations introduced by TALEN pair TaSBEIIa_T01

SEQ ID NO: 7067 - DNA, 292 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaatcgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaatttggggaacatcaaagagacaaagactagggaccactatttcttacagttcccctcatggtctgagaatatgctggga

SEQ ID NO: 7068 - DNA, 413 bp, Artificial
  TaSBEIIa  allele with mutations introduced by TALEN pair TaSBEIIa_T01
  misc_feature (287): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatntaacgagctacttcgctcattttgaattaaggtcctttcgtcatgcaaatttgggaacatcaaagagacaaagactagggaccactatttctacagttcccctcatggtctgagaatatgctggga

SEQ ID NO: 7069 - DNA, 451 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaaccaggagatgggtagaaaatatacgagattgacccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7070 - DNA, 451 bp, Artificial
  TaSBEIIa  allele with mutations introduced by TALEN pair TaSBEIIa_T01
tcagatggatgtgcttctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctacccgctgcttttcgctcattttgaattaaggtcctttcatcatgcaaatttggggaacatcaaagagacaaagactagggaccaccatttcatacagatcccctcgtggtctgagaatatgctggga

SEQ ID NO: 7071 - DNA, 453 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctaccgctgctttcgctcattttgaattaaggtcctttcatcatgcaaatttggggaacatcaaagagacaaagactagggaccaccatttcatacagatcccctgtggtctgagaatatgctggga

SEQ ID NO: 7072 - DNA, 451 bp, Artificial
  TaSBEIIa  allele with mutations introduced by TALEN pair TaSBEIIa_T01
  misc_feature (383): n is a or c or t or g
tcagatggatgtgcattctagcaagaacttcacgaaataatgcactgtttgtggtttcgttagtctgatctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctacccgctactttcgctcattttgaattaaggtcctttcgtcatgcaaattttggggaacntcaaagagacaaagactagggaccactatttcttacagttcccctcatggtctgagaatatgctggga

SEQ ID NO: 7073 - DNA, 463 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctggagccatcttgactaccggtaatgcctacccgctactttcgctcattttgaattaaggtcctttcgtcatgcaaatttggggaacatcaaagagacaaagactagggaccactatttcttacagtttcccctcatggtctgagaatatgctggga

SEQ ID NO: 7074 - DNA, 426 bp, Artificial; identical to SEQ ID NO: 6891
  TaSBEIIa  allele with mutations introduced by TALEN pair TaSBEIIa_T01

SEQ ID NO: 7075 - DNA, 448 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaactgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7076 - DNA, 393 bp, Artificial; identical to SEQ ID NO: 6210
  TaSBEIIa  allele with mutations introduced by TALEN pair TaSBEIIa_T01

SEQ ID NO: 7077 - DNA, 452 bp, Artificial; identical to SEQ ID NO: 6866
  TaSBEIIa  allele with mutations introduced by TALEN pair TaSBEIIa_T01

SEQ ID NO: 7078 - DNA, 436 bp, Artificial; identical to SEQ ID NO: 6302
  TaSBEIIa  allele with mutations introduced by TALEN pair TaSBEIIa_T01

SEQ ID NO: 7079 - DNA, 380 bp, Artificial; identical to SEQ ID NO: 6194
  TaSBEIIa  allele with mutations introduced by TALEN pair TaSBEIIa_T01

SEQ ID NO: 7080 - DNA, 395 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagactttcgctcattttgaattaaggtcctttcgtcatgcaaattttggggaacatcaaagagacaaagactagggaccactatttccttacagttcccctcatggtctgagaatatgctggga

SEQ ID NO: 7081 - DNA, 456 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgactcggagccatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 7082 - DNA, 455 bp, Artificial; identical to SEQ ID NO: 6767
  TaSBEIIa  allele with mutations introduced by TALEN pair TaSBEIIa_T01

SEQ ID NO: 7083 - DNA, 378 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgaccgctactttcgctcattttgaattaaggtcctttcgtcatgcaaatttggggaacatcaaagagacaaagactagggaccactattcttacagttcccctcatggtctgagaatatgctggga

SEQ ID NO: 7084 - DNA, 435 bp, Artificial
  TaSBEIIa  allele with mutations introduced by TALEN pair TaSBEIIa_T01
  misc_feature (348): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagactaccggtaatgcctacccgctgctttcgctcattttgaattaaggtcctttnatcatgcaaatttgggaacatcaaagagacaaagactagggaccaccatttcatacagatcccctgtggtctgagaatatgctggga

SEQ ID NO: 7085 - DNA, 443 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaatgcctacccgctactttcgctcattttgaattaaggtccttttcgtcatgcaaatttggggaacatcaaagagacaaagactagggaccactatttcttacagttcccctcatggtctgagaatatgctggga

SEQ ID NO: 7086 - DNA, 460 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacattttcggagccatcttgactaccggtaatgcctacccgctgctttcgctcattttgaattaaggtcctttcatcatgcaaatttggggaacatcaaagagacaaagactagggaccaccattcatacagatcccctcgtggtctgagaatatgctggga

SEQ ID NO: 7087 - DNA, 465 bp, Artificial
  TaSBEIIa  allele with mutations introduced by TALEN pair TaSBEIIa_T01
  misc_feature (344): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctttcggagccatcttgactaccggtaatgcctacccgntactttcgctcattttgaattaaggtcctttcgtcatgcaaatttggggaacatcaaagagacaaagactagggaccactatttcttacagttcccctcatggtctgagaatatgctggga

SEQ ID NO: 7088 - DNA, 453 bp, Artificial; identical to SEQ ID NO: 6790
  TaSBEIIa  allele with mutations introduced by TALEN pair TaSBEIIa_T01

SEQ ID NO: 7089 - DNA, 375 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaaattaaggtcctttcatcatgcaaatttggggaacatcaaagaggcaaagactagggaccactattcatacagttcccctcatggtctgagaatatgctggga

SEQ ID NO: 7090 - DNA, 446 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtggggagaaaccgcgagttgtcccaaaaccaggagatgggcagaaaatatacgagccatcttgactaccggtaatgcctacccgctgctttcgctcattttgaattaaggtcctttcatcatgcaaatttggggaacatcaaagagacaaagactaagggaccaccatttcatacagaatcccctcgtggtctgagaatatgctggga

SEQ ID NO: 7091 - DNA, 451 bp, Artificial; identical to SEQ ID NO: 6228
  TaSBEIIa  allele with mutations introduced by TALEN pair TaSBEIIa_T01

SEQ ID NO: 7092 - DNA, 448 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7093 - DNA, 454 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccatcttgactaccggtaatgcctacccgctaatttcgctcattttgaattaaggtcctttcatcatgcaaatttggggaacatacaaagaggcaaagactagggaccactatttcatacagttcccctcatggtctgagaatatgctggga

SEQ ID NO: 7094 - DNA, 450 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaataaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7095 - DNA, 415 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagatactttcgctcattttgaattaaggtccttttcgtcatgcaaatttgggaacatcaaagagacaaagactagggaccactatttcttacagttcccctcatggtctgagaatatgctggga

SEQ ID NO: 7096 - DNA, 438 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatataatcttgactaccggtaatgcctacccgctactttcgctcattttgaattaaggtcctttcgtcatgcaaatttggggaacatcaaagagacaaagactagggaccactattcttacacgttcccctcatggtctgagaatatgctggga

SEQ ID NO: 7097 - DNA, 351 bp, Artificial; identical to SEQ ID NO: 6441
  TaSBEIIa  allele with mutations introduced by TALEN pair TaSBEIIa_T01

SEQ ID NO: 7098 - DNA, 426 bp, Artificial
  TaSBEIIa  allele with mutations introduced by TALEN pair TaSBEIIa_T01
tcagatgatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7099 - DNA, 427 bp, Artificial; identical to SEQ ID NO: 6312
  TaSBEIIa  allele with mutations introduced by TALEN pair TaSBEIIa_T01

SEQ ID NO: 7100 - DNA, 407 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaggagttaaggaactagtcgtgggggagaaaccgcgagttgtcccaaactaccggtaatgcctacccgctactttcgctctattttgaattaaggtcctttcgtcatgcaaatttggggaacatcaaagagacaaagactagggaccactatttcttacagttcccctcatggtctgagaatatgctggga

SEQ ID NO: 7101 - DNA, 446 bp, Artificial; identical to SEQ ID NO: 6227
  TaSBEIIa  allele with mutations introduced by TALEN pair TaSBEIIa_T01

SEQ ID NO: 7102 - DNA, 454 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagatttcggagccatcttgactaccggtaatgcctacccgctaactttcgctcattttgaattaaggtcctttcgtcatgcaaatttggggaacatcaaagagacaaaagactagggaccactatttcttacagttccctcatggtctgagaatatgctggga

SEQ ID NO: 7103 - DNA, 451 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttcggagccatcttgactaccggtaatgcctaccgctgctttcgctcattttgaattaaggtcctttcatcatgcaaatttgggaacatcaaagagacaagactagggaccaccatttcatacagatcccctcgtggtctgagaatatgctggga

SEQ ID NO: 7104 - DNA, 445 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgactaccggtaatgcctacccgctaatttcgctctattttgaattaaggtcctttcatcatgcaaatttggggaacatcaaagaggacaaagactagggaccactatttcatacagttcccctcatggtctgagaatatgctggga

SEQ ID NO: 7105 - DNA, 460 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacattttcggagccatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctggga

SEQ ID NO: 7106 - DNA, 430 bp, Artificial; identical to SEQ ID NO: 6337
  TaSBEIIa  allele with mutations introduced by TALEN pair TaSBEIIa_T01

SEQ ID NO: 7107 - DNA, 366 bp, Artificial; identical to SEQ ID NO: 6175
  TaSBEIIa  allele with mutations introduced by TALEN pair TaSBEIIa_T01

SEQ ID NO: 7108 - DNA, 450 bp, Artificial; identical to SEQ ID NO: 6343
  TaSBEIIa  allele with mutations introduced by TALEN pair TaSBEIIa_T01

SEQ ID NO: 7109 - DNA, 455 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcatcttgactaccggtaatgcctacccgctactttcgctcattttgaattaaggtcctttcgtcatgcaaatttggggaacatcaaagagaacaaagactagggaccactattcttacagttcccctcatggtctgagaatatgctggga

SEQ ID NO: 7110 - DNA, 441 bp, Artificial; identical to SEQ ID NO: 6930
  TaSBEIIa  allele with mutations introduced by TALEN pair TaSBEIIa_T01

SEQ ID NO: 7111 - DNA, 428 bp, Artificial; identical to SEQ ID NO: 6391
  TaSBEIIa  allele with mutations introduced by TALEN pair TaSBEIIa_T01

SEQ ID NO: 7112 - DNA, 449 bp, Artificial; identical to SEQ ID NO: 6275
  TaSBEIIa  allele with mutations introduced by TALEN pair TaSBEIIa_T01

SEQ ID NO: 7113 - DNA, 468 bp, Artificial
  TaSBEIIa  allele with mutations introduced by TALEN pair TaSBEIIa_T01
  misc_feature (446): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctgaggagccatcttgactaccggtaatgcctacccgctaatttcgctcattttgaattaaggtcctttcatcatgcaaatttggggaacatcaaagaggacaaagactagggaccactatttcatacagttcccctnatggtctgagaatatgctggga

SEQ ID NO: 7114 - DNA, 293 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaatttggggaacatcaaagagacaaagactagggaccactatttcttacagttcccctcatggtctgagaatatgctgggaa

SEQ ID NO: 7115 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgcttggga

SEQ ID NO: 7116 - DNA, 336 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagacatgcaaaatttggggaacatcaaagaggcaaagactagggaccactattcatacagttcccctcatggtctgagaatatgctggga

SEQ ID NO: 7117 - DNA, 449 bp, Artificial
  TaSBEIIa  allele with mutations introduced by TALEN pair TaSBEIIa_T01
  misc_feature (442): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcaagaaaatatacgagattgacccatcttgactaccggtaatgcctaccgctgctttcgctcattttgaattaaggtcctttcatcatgcaaatttgggaacatcaaagagacaaagactaggaccaccatttcatacagatcccctcgtggtctgagaatangctggga

SEQ ID NO: 7118 - DNA, 366 bp, Artificial; identical to SEQ ID NO: 6175
  TaSBEIIa  allele with mutations introduced by TALEN pair TaSBEIIa_T01

SEQ ID NO: 7119 - DNA, 456 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttttcggagccatcttgactaccggtaatgcctaccgctgctttcgctcattttcgaattaaggtcctttcatcatgcaaatttggggaacatcaaagagacaaagactagggaccaccatttcatacagatcccctcgtggtctgagaatatgctggga

SEQ ID NO: 7120 - DNA, 452 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgaccggtaatgcctacccgctgctttcgctcattttgaattaaggtccttttcatcatgcaaatttggggaacatcaaagagacaaagactagggaccaccatttcatacagatccccctgtggtctgagaatatgctggactgagcagcaagca

SEQ ID NO: 7121 - DNA, 440 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacatcttgactaccggtaatgcctacccgctaatttcgctcattttgaattaaggtcctttcatcatgcaaatttggggaacatcaaagaggcaaagactagggaccactattcatacagttcccctcatggtctgagaatatgctgga

SEQ ID NO: 7122 - DNA, 439 bp, Artificial; identical to SEQ ID NO: 6774
  TaSBEIIa  allele with mutations introduced by TALEN pair TaSBEIIa_T01

SEQ ID NO: 7123 - DNA, 439 bp, Artificial
  TaSBEIIa  allele with mutations introduced by TALEN pair TaSBEIIa_T01
  misc_feature (417): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatcttgactaccggtaatgcctacccgctaatttcgactcattttgaattaaggtcctttcatcatgcaaatttggggaacatcaaagaggcaaagactagggaccactatttcatacagttcccctnatggtctgagaatatgctggga

SEQ ID NO: 7124 - DNA, 390 bp, Artificial; identical to SEQ ID NO: 6610
  TaSBEIIa  allele with mutations introduced by TALEN pair TaSBEIIa_T01

SEQ ID NO: 7125 - DNA, 427 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgcatcttgactaccggtaatgcctacccgctgctttcgctcattttgaattaaggtccttttcatcatgcaaatttggggaacatcaaagagacaaagactagggaccaccatttcatacagatcccctcgtgtctgagaatatgctggga

SEQ ID NO: 7126 - DNA, 467 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaagattttcggagccatcttgactaccggtaatgcctacccgctgctttcgctcattttgaattaaggtcctttcatcatgcaaatttggggaacatcaaagagacaaagactagggaccaccatttcatacagatcccctcgtcggtctgagaatatgctggga

SEQ ID NO: 7127 - DNA, 472 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgccttacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7128 - DNA, 427 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaaccaaaggagttaaggaactagtcgtgggggagaaaccgcgagttgtcccaaaaccaggagatgcatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctgga

SEQ ID NO: 7129 - DNA, 422 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacatgcctaccgctgctttcgctcattttgaattaaggtcctttcatcatgcaaatttggggaacatcaaagagacaaagactagggaccaccatttcatacagatcccctcgtggtctgagatatgctggga

SEQ ID NO: 7130 - DNA, 465 bp, Artificial; identical to SEQ ID NO: 7016
  TaSBEIIa  allele with mutations introduced by TALEN pair TaSBEIIa_T01

SEQ ID NO: 7131 - DNA, 414 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttttcggagccatcttgactaccggtaatgcctacccgctgctttcgctcattttgaattaaggtcctttcatcatgcaaatttgggaacatcaaagagacaaagactagggaccaccatttcatacagatcccctcgtggtctgagaatatgctgga

SEQ ID NO: 7132 - DNA, 392 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagactttcgctcattttgaattaaggtcctttcgtcatgcaaatttggggaacatcaaagagacaaagactagggaccatatttcttacagttcccctcatggtctgagaatatgctggga

SEQ ID NO: 7133 - DNA, 430 bp, Artificial; identical to SEQ ID NO: 6787
  TaSBEIIa  allele with mutations introduced by TALEN pair TaSBEIIa_T01

SEQ ID NO: 7134 - DNA, 457 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccggagccatcttgactaccggtaatgcctacccgctgctttcgctcattttgaattaaggtcctttcatcatgcaaatttgggaacatcaaagagaacaaagactagggaccaccatttcatacagatcccctcgtggtctgagaatatgctggga

SEQ ID NO: 7135 - DNA, 452 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctacccgctgctttcgctcattttgaattaaggtcctttcatcatgcaaatttgggaacatcaaagagacaaagactagggaccaccattcatacagatccctcgtggtctgagaatatgctggga

SEQ ID NO: 7136 - DNA, 466 bp, Artificial
  TaSBEIIa  allele with mutations introduced by TALEN pair TaSBEIIa_T01
  misc_feature (459): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctttcggagccatcttgactaccggtaatgcctacccgctactttcgctcattttgaattaaggtcctttcgtcatgcaaatttggggaacatacaaagagacaaagactagggaccactatttcttacagttcccctcatggtctgagaatangctggga

SEQ ID NO: 7137 - DNA, 441 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagaatcttgactaccggtaatgcctacccgctactttcgctcattttgaattaaggtcctttcgtcatgcaaattggggaacatcaaagagacaaagactagggaccactatttcttacagttcccctcatggtctgagaatatgctgga

SEQ ID NO: 7138 - DNA, 447 bp, Artificial
  TaSBEIIa  allele with mutations introduced by TALEN pair TaSBEIIa_T01
  misc_feature (425): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccttgactaccggtaatgcctacccgctactttcgctcattttgaattaaggtcctttcgtcatgcaaatttggggaacatcaaagagacaaagactagggaccactatttcttacagttcccctanatggtctgagaatatgctggga

SEQ ID NO: 7139 - DNA, 452 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctacccgctactttcgctcattttgaattaaggtcctttcgtcatgcaaatttgggaacatcaaagagacaaagactaaggggaccactatttcttacacgttcccctcatggtctgagaatatgctggga

SEQ ID NO: 7140 - DNA, 468 bp, Artificial
  TaSBEIIa  allele with mutations introduced by TALEN pair TaSBEIIa_T01
tcagatggatgtgcattctagcaagaacttcacaacataatgcaccgtttgggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaagattttcggagccatcttgactaccggtaatgcctacccgctgctttcgctcattttgaattaaggtcctttcatcatgcaaatttggggaacatcaaagagacaaagactagggaccaccatttcatacagactcccctcgtggtctgagaatatgctggga

SEQ ID NO: 7141 - DNA, 445 bp, Artificial; identical to SEQ ID NO: 7022
  TaSBEIIa  allele with mutations introduced by TALEN pair TaSBEIIa_T01

SEQ ID NO: 7142 - DNA, 437 bp, Artificial
  TaSBEIIa  allele with mutations introduced by TALEN pair TaSBEIIa_T01
tcagatggatgtgcattctagcaagaacttcacgaaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 7143 - DNA, 366 bp, Artificial; identical to SEQ ID NO: 6175
  TaSBEIIa  allele with mutations introduced by TALEN pair TaSBEIIa_T01

SEQ ID NO: 7144 - DNA, 447 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaaccaggagatgggcagaaaatatttcggagccatcttgactaccggtaatgcctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 7145 - DNA, 453 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcccatcttgactaccggtaatgcctaccgctactttcgctcattttgaattaaggtcctttcgtcatgcaaatttggggaacatcaaagagaacaagactagggaccactattctacagttccctcatggtctgagaatatgctggga

SEQ ID NO: 7146 - DNA, 444 bp, Artificial
  TaSBEIIa  allele with mutations introduced by TALEN pair TaSBEIIa_T01
  misc_feature (422): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagagccatcttgactaccggtaatgcctaccgctactttcgctcattttgaattaaggtcctttcgtcatgcaaatttggggaacatcaaagagacaaagactagggaccactatttctacagttcccctnatggtctgagaatatgctggga

SEQ ID NO: 7147 - DNA, 461 bp, Artificial
  TaSBEIIa  allele with mutations introduced by TALEN pair TaSBEIIa_T01
tcagatggatgtgctctagcaagaacttcacgaaaataatgcactgtttgtggtttcgttagtctgctctacaattgctattttcgtgctgtagatacctgaagacatcgaggagcaaacggctgaagtaacatgacagggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctttcggagccatcttgactaccggtaatgcctacccgctactttcgctcattttgaattaaggtcctttgtcatgcaaatttggggaacatcaaagagacaaagactagggaccactatttcttacagttcccctcatggtctgagaatatgctggga

SEQ ID NO: 7148 - DNA, 458 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcccatcttgactaccggtaatgcctaccgctactttcgctcattttgaatttaaggtcctttcgtcatgcaaatttggggaacatcaaagagacaaagactagggaccactatttcttacacgttcccctcatggtctgagaatatgctggga

SEQ ID NO: 7149 - DNA, 463 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaaagccatcttgactaccggtaatgcctacccgctactttcgctcattttgaattaaggtcctttcgtcatgcaaactttgggaacatacaaagagacaaagactagggaccactattcttacagttccctcatggtctgagaatatgctaggga

SEQ ID NO: 7150 - DNA, 449 bp, Artificial
  TaSBEIIa  allele with mutations introduced by TALEN pair TaSBEIIa_T01
  misc_feature (425): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctacccgctactttcgctcattttgaattaaggtccttttcgtcatgcaaatttggggaacatcaaagagacaaagactagggaccactatttcttacagttccccctanatggtctagagaatatgcgtggga

SEQ ID NO: 7151 - DNA, 452 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttcggagccatcttgactaccggtaatgcctacccgctgctttcgctcattttgaattaaggtcctttcatcatgcaaatttgggaacatcaaagagacaaagactagggaccaccatttcatacagatcccctgtggtctgagaatatgctggga

SEQ ID NO: 7152 - DNA, 315 bp, Artificial; identical to SEQ ID NO: 6456
  TaSBEIIa  allele with mutations introduced by TALEN pair TaSBEIIa_T01

SEQ ID NO: 7153 - DNA, 428 bp, Artificial; identical to SEQ ID NO: 6354
  TaSBEIIa  allele with mutations introduced by TALEN pair TaSBEIIa_T01

SEQ ID NO: 7154 - DNA, 456 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccgaagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7155 - DNA, 438 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattaccggtaatgcctacccgctactttcgctcattttgaattaaggtcctttcgtcatgcaaatttggggaacatcaaaagagacaaagactaagggaccactatttcttacagttcccctcatggtctgagaatatgctggga

SEQ ID NO: 7156 - DNA, 343 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtccaaagtttggggaacatcaaagagacaaagactagggaccactatttcttacagttcccctcatggtctgagaatatgctgga

SEQ ID NO: 7157 - DNA, 427 bp, Artificial; identical to SEQ ID NO: 6312
  TaSBEIIa  allele with mutations introduced by TALEN pair TaSBEIIa_T01

SEQ ID NO: 7158 - DNA, 413 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacccgctactttcgctcattttgaattaaggtcctttcgtcatgcaaatttggggaacatcaaagagacaaagactagggaccactattcttacagttccctcatggtctgagaatatgctggga

SEQ ID NO: 7159 - DNA, 456 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacctcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7160 - DNA, 433 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagccatcttgactaccggtaatgcctaccgctgctttcgctcattttgaattaaggtcctttcatcatgcaaatttggggaacatcaaagagaacaaagactagggaccaccatttcatacagatcccctcgtggtctgagaatatgctggga

SEQ ID NO: 7161 - DNA, 440 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattaccggtaatgcctacccgctaatttcgctcattttgaattaaggtcctttcatcatgcaaatttggggaacatcaaagaggacaaagactagggaccactatttcatacagttcccctcatggtctgagaatatgctggga

SEQ ID NO: 7162 - DNA, 368 bp, Artificial
  TaSBEIIa  allele with mutations introduced by TALEN pair TaSBEIIa_T01
tcagatggatgtgcattactagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttggggaacatcaaaagagacaaagactagggaccactatttcttacagttcccctcatggtctgagaatatgctggga

SEQ ID NO: 7163 - DNA, 339 bp, Artificial; identical to SEQ ID NO: 6123
  TaSBEIIa  allele with mutations introduced by TALEN pair TaSBEIIa_T01

SEQ ID NO: 7164 - DNA, 483 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccatcttgactaccggtaatgcctaccgctactttcgctcattttgaattaaggtcctttcgtcatgcaaatttggggaacatcaaagagacaaagactagggaccactattcttacagttcccctcatggtctgagaatatgctgggactgaactgccaaggcacacaggggatagg

SEQ ID NO: 7165 - DNA, 426 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtccaaaaccaggagatgcatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7166 - DNA, 439 bp, Artificial; identical to SEQ ID NO: 6586
  TaSBEIIa  allele with mutations introduced by TALEN pair TaSBEIIa_T01

SEQ ID NO: 7167 - DNA, 442 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacatcttgactaccggtaatgcctacccgctaatttcgctcattttgaattaaggtccttcatcatgcaaatttggggaacatcaaagaggacaaagactagggaccactatttcatacagttcccctcatggtctgagaatatgctggga

SEQ ID NO: 7168 - DNA, 377 bp, Artificial; identical to SEQ ID NO: 6683
  TaSBEIIa  allele with mutations introduced by TALEN pair TaSBEIIa_T01

SEQ ID NO: 7169 - DNA, 457 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaaccaggagatgggcagaaaatatacgagattgacccggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7170 - DNA, 449 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaaatatacgagattgaccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctgga

SEQ ID NO: 7171 - DNA, 445 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccggtaatgcctacccgctactttcgctcattttgaattaaggtcctttcgtcatgcaaatttggggaacatcaaagagacaaagactagggaccactatttcttacagttcccctcatggtctgtagaatatgctggga

SEQ ID NO: 7172 - DNA, 439 bp, Artificial; identical to SEQ ID NO: 6214
  TaSBEIIa  allele with mutations introduced by TALEN pair TaSBEIIa_T01

SEQ ID NO: 7173 - DNA, 430 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaaccaaaggagttaaggaactagtcgtgggggagaaaccgcgagttgtcccaaaaccaggagatggccatcttgactaccggtaatgcctacccgctgctttcgctcattttgaattaaggtcctttcatcatgcaaatttgggaacatcaaagagacaaagactagggaccaccatttcatacagactcccctcgtggtctgagaatatgctggga

SEQ ID NO: 7174 - DNA, 450 bp, Artificial; identical to SEQ ID NO: 6343
  TaSBEIIa  allele with mutations introduced by TALEN pair TaSBEIIa_T01

SEQ ID NO: 7175 - DNA, 376 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacagggggggaccgcagagaaacttgaatcttcagaaccgactcagggcattgtggaaacaatcactgatggtgtaaccaaaggagttaaggaactagtcgcgggggagaaaccgcgagttgtcccaaaaccaattaaggtcctttcatcatgcaaatttggggaacatcaaagaggcaaagactagggaccactatttcatacagttcccctcatggtctgagaatatgctggga

SEQ ID NO: 7176 - DNA, 436 bp, Artificial
  TaSBEIIa  allele with mutations introduced by TALEN pair TaSBEIIa_T01
  misc_feature (348): n is a or c or t or g
tcagatggatgtgcattactagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagctaccggtaatgcctacccgctgctttcgctcattttgaattaaggtcctttnatcatgcaaatttggggaacatcaaagagacaaagactagggaccaccatttcatacagatcccctgtggtctgagaatatgctggga

SEQ ID NO: 7177 - DNA, 473 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccaacactgattttcggagccatcttgactaccggtaatgcctacccgctgctttcgctcattttgaattaaggtcctttcatcatgcaaatttggggaacatacaaagagacaaagactagggaccaccatttcatacagactcccctcgtggtctgagaataatgctggga

SEQ ID NO: 7178 - DNA, 425 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgcctacccgctacttcgctcattttgaattaaggtcctttcgtcatgcaaatttggggaacatcaaagagacaaagactagggaccactatttctacagttccctcatggtctgagaatatgactggga

SEQ ID NO: 7179 - DNA, 345 bp, Artificial
  TaSBEIIa  allele with mutations introduced by TALEN pair TaSBEIIa_T01
  misc_feature (323): n is a or c or t or g
tcagatggatgtgcagttactagcaagaacttcaacgaataatgcgactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtccaaatttggggaacatcaaagagacaaagactagggaccactatttctacagttcccctnatggtctgagaatatgctggga

SEQ ID NO: 7180 - DNA, 463 bp, Artificial
  TaSBEIIa  allele with mutations introduced by TALEN pair TaSBEIIa_T01
  misc_feature (440): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaaagccatcttgactaccggtaatgcctacccgctactttcgctcattttgaattaaggtcctttcgtcatgccaaatttggggaacatcaaagagacaaagactagggaccactatttctacagttccccncatggtctgagaatatgctggga

SEQ ID NO: 7181 - DNA, 443 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7182 - DNA, 444 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7183 - DNA, 440 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgacttgactaccggtaatgcctacccgctactttcgctcattttgaattaaggtcctttcgtcatgcaaatttggggaacatcaaagagacaaagactagggaccactatttcttacagttcccctcatggtactgagaatatgctggga

SEQ ID NO: 7184 - DNA, 453 bp, Artificial; identical to SEQ ID NO: 6432
  TaSBEIIa  allele with mutations introduced by TALEN pair TaSBEIIa_T01

SEQ ID NO: 7185 - DNA, 453 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7186 - DNA, 450 bp, Artificial
  TaSBEIIa  allele with mutations introduced by TALEN pair TaSBEIIa_T01
tcagatggatgttgcattactagcaagaacttcacgaaataatgcgactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7187 - DNA, 416 bp, Artificial; identical to SEQ ID NO: 6131
  TaSBEIIa  allele with mutations introduced by TALEN pair TaSBEIIa_T01

SEQ ID NO: 7188 - DNA, 447 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacatcttgactaccggtaatgcctacccgctactttcgctcattttgaattaaggtcctttcgtcatgcaaatttggggaacatcaaagagacaaagactagggaccactatttctacagttcccctcatggtctgagaatatgctggga

SEQ ID NO: 7189 - DNA, 454 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctacccgctgcttttcgctcattttgaattaaggtcctttcatcatgcaaatttgggaacatcaaagagacaaagactagggaccaccatttcatacagatcccctgtggtctgagaatatgctggga

SEQ ID NO: 7190 - DNA, 460 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgttttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7191 - DNA, 447 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 7192 - DNA, 447 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaagctgaaagataatgcctaccgctactttcgctcattttgaattaaggtcctttcgtcatgcaaaatttggggaacatcaaagagacaaagactagggaccactaatttctacagttcccctcatggtctgagaatatgctggga

SEQ ID NO: 7193 - DNA, 440 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggggagaaaccgcgagttgtcccaaaaccaggagatgggcagaaaatataatcttgactaccggtaatgcctacccgctactttcgctcattttgaattaaggtcctttcgtcatgcaaatttggggaacatcaaagagacaaagactagggaccactatttcttaacagttcccctcatggtctgagaatatgctggga

SEQ ID NO: 7194 - DNA, 444 bp, Artificial; identical to SEQ ID NO: 6698
  TaSBEIIa  allele with mutations introduced by TALEN pair TaSBEIIa_T01

SEQ ID NO: 7195 - DNA, 437 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatggtcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7196 - DNA, 455 bp, Artificial
  TaSBEIIa  allele with mutations introduced by TALEN pair TaSBEIIa_T01
tcagatggatgtgcattctagcaagaacttcacaacataatgcatcgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttttcggagccatcttgactaccggtaatgcctacccgctgctttcgctcattttgaattaaggtcctttcatcatgcaatttggggaacatcaaagagacaaagactagggaccaccatttcatacagatcccctcgtggtctgagaatatgctggga

SEQ ID NO: 7197 - DNA, 366 bp, Artificial; identical to SEQ ID NO: 6175
  TaSBEIIa  allele with mutations introduced by TALEN pair TaSBEIIa_T01

SEQ ID NO: 7198 - DNA, 404 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatttcgctcattttgaattaaggtcctttcgtcatgcaaatttggggaacatcaaagagacaaagactagggaccactattcttacagttcccctcatggtctgagaatatgctggga

SEQ ID NO: 7199 - DNA, 428 bp, Artificial
  TaSBEIIa  allele with mutations introduced by TALEN pair TaSBEIIa_T01
  misc_feature (405): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacggtaatgcctacccgctactttcgctcattttgaattaaggtcctttcgtcatgcaaatttggggaacatcaaagagacaaagactagggaccactatttcttacagttcccctnactggtctgagaatatgctggga

SEQ ID NO: 7200 - DNA, 372 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgcctctacaattgctatttttcgtgctgtagatacctgaagatatcgaggaggcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttcattttgaattaaggtcctttcatcatgcaaattttggggaacatcaaagagacaaagactagggaccaccatttcatacagatcccctcgtggtctgagaatatgctggga

SEQ ID NO: 7201 - DNA, 447 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccttgactaccggtaatgcctacccgctactttcgctcattttgaattaaggtcctttcgtcatgcaaatttggggaacatcaaagagacaaagactagggaccactatttcttacacgttcccctcatggtctgagaatatgctggga

SEQ ID NO: 7202 - DNA, 449 bp, Artificial
  TaSBEIIa  allele with mutations introduced by TALEN pair TaSBEIIa_T01
  misc_feature (427): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgcatcttgactaccggtaatgcctaccgctactttcgctcattttgaattaaggtcctttcgtcatgcaaaatttggggaacatcaaagagacaaagactaggggaccactatttcttacagttccccctnatggtctgagaatatgctggga

SEQ ID NO: 7203 - DNA, 415 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttttcggagccatcttgactaccggtaatgcctacccgctgctttcgctcattttgaattaaggtcctttcatcatgcaaatttggggaacatcaaagagacaaagactagggaccaccatttcatacagatccctcgtggtctgagaatatgctggga

SEQ ID NO: 7204 - DNA, 416 bp, Artificial; identical to SEQ ID NO: 6584
  TaSBEIIa  allele with mutations introduced by TALEN pair TaSBEIIa_T01

SEQ ID NO: 7205 - DNA, 453 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgcatcttgactaccggtaatgcctaccgctactttcgctcattttgaattaaggtcctttcgtcatgcaaatttggggaacatcaaagagacaaagactagggaccactatttcttacagttcccctcatggtctgagatatgctggga

SEQ ID NO: 7206 - DNA, 462 bp, Artificial
  TaSBEIIa  allele with mutations introduced by TALEN pair TaSBEIIa_T01
  misc_feature (342): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaaatatacgagattgacctttcggagccatcttgactaccggtaatgcctacccgntaatttcgctcattttgaattaaggtcctttcatcatgcaaatttgggaacatcaaagaggcaaagactagggaccactatttcatacagttcccctcatggtctgagaatatgctggga

SEQ ID NO: 7207 - DNA, 461 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaaagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 7208 - DNA, 335 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaattaaggtcctttcatcatgcaaatttggggaacatcaaagaggcaaagactagggaccactatttcatacagttcccctcatggtctgagaatatgctggga

SEQ ID NO: 7209 - DNA, 440 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagtcggagccatcttgactaccggtaatgcctacccgctaatttcgctcattttgaattaaggtcctttcatcatgcaaatttggggaacatcaaagaggcaaagactagggaccactatttcatacagttcccctcatggtctgagatatgctggga

SEQ ID NO: 7210 - DNA, 337 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgaaggtcctttcatcatgcaaatttggggaacatcaaagagacaaagactagggaccaccattcatacagatcccctcgtggtctgagaatatgctggga

SEQ ID NO: 7211 - DNA, 423 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacatgcctacccgctgctttcgctcattttgaattaaggtcctttcatcatgcaaatttggggaacatcaaagagacaaagactagggaccacatttcatacagatcccctcgtggtctgagaatatgctggga

SEQ ID NO: 7212 - DNA, 454 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgccatcttgactaccggtaatgcctaccgctacttcgctcattttgaattaaggtcctttcgtcatgcaaatttggggaacatcaaagagacaaagactagggaccactatttcttacagttcccctcatggtctgagaatatgctggga

SEQ ID NO: 7213 - DNA, 380 bp, Artificial; identical to SEQ ID NO: 6194
  TaSBEIIa  allele with mutations introduced by TALEN pair TaSBEIIa_T01

SEQ ID NO: 7214 - DNA, 455 bp, Artificial
  TaSBEIIa  allele with mutations introduced by TALEN pair TaSBEIIa_T01
  misc_feature (365): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctaccgctgctttcgctcattttgaattaaggtcctttnatcatgcaaatttggggaacatcaaagagacaaagactagggaccaccatttcatacagatcccctcgtggtctgagaatatgactggga

SEQ ID NO: 7215 - DNA, 437 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaataccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7216 - DNA, 465 bp, Artificial; identical to SEQ ID NO: 7016
  TaSBEIIa  allele with mutations introduced by TALEN pair TaSBEIIa_T01

SEQ ID NO: 7217 - DNA, 382 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgaattaaggtcctttcgtcatgcaaattttggggaacatcaaagagacaaaagactagggaccactatttcttacagttcccctcatggtctgagaatatgctggga

SEQ ID NO: 7218 - DNA, 437 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagactaccggtaatgcctacccgctgcttttcgctcattttgaattaaggtcctttcatcatgcaaatttggggaacatcaaagagacaaagactagggaccaccatttcatacagatcccctcgtgtctgagaatatgctggga

SEQ ID NO: 7219 - DNA, 445 bp, Artificial
  TaSBEIIa  allele with mutations introduced by TALEN pair TaSBEIIa_T01
tcagatggatgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccttgactaccggtaatgcctacccgctactttcgctcattttgaattaaggtcctttcgtcatgcaaatttggggaacattcaaagagacaaagactagggaccactatttcttacagttcccctcatggtctgagaatatgctggga

SEQ ID NO: 7220 - DNA, 342 bp, Artificial
  TaSBEIIa  allele with mutations introduced by TALEN pair TaSBEIIa_T01
tcagatggatgtgcattctgcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtccaaatttggggaacatcaaagagacaaagactagggaccactatttcttacagttcccctcatggtctgagaatatgctggga

SEQ ID NO: 7221 - DNA, 367 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgctcattttgaattaaggtcctttcgtcatgcaaatttggggaacatcaaagagacaaagactagggaccactattttcttacagttcccctcatggtctgagaatatgctggga

SEQ ID NO: 7222 - DNA, 416 bp, Artificial; identical to SEQ ID NO: 6131
  TaSBEIIa  allele with mutations introduced by TALEN pair TaSBEIIa_T01

SEQ ID NO: 7223 - DNA, 339 bp, Artificial; identical to SEQ ID NO: 6123
  TaSBEIIa  allele with mutations introduced by TALEN pair TaSBEIIa_T01

SEQ ID NO: 7224 - DNA, 401 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagctttcgctcattttgaattaaggtcctttcgtcatgcaaatttggggaacatcaaagagacaaagactagggaccactatttcttacagttcccctcatggtctgagaatatgctgggga

SEQ ID NO: 7225 - DNA, 428 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgaccctacccgctacttcgctcattttgaattaaggtcctttcgtcatgcaaatttggggaacatcaaagagacaaagactagggaccactatttcttacagttcccctcatggtctgagaatatgctggga

SEQ ID NO: 7226 - DNA, 421 bp, Artificial
  TaSBEIIa  allele with mutations introduced by TALEN pair TaSBEIIa_T01
tcagatggatgtgcattctagcaagaacttcacaacataatggcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7227 - DNA, 449 bp, Artificial; identical to SEQ ID NO: 6275
  TaSBEIIa  allele with mutations introduced by TALEN pair TaSBEIIa_T01

SEQ ID NO: 7228 - DNA, 460 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaaccaggagatgggcagaaaatatacgagattgacccggagccatcttgactaccggtaatgcctacccgctgctttcgctcatttttgaattaaggtcctttcatcatgcaaatttggggaacatcaaaagagacaaagactagggaccaccatttcatacagatcccctcgtggtctgagaatatgctggga

SEQ ID NO: 7229 - DNA, 453 bp, Artificial; identical to SEQ ID NO: 6938
  TaSBEIIa  allele with mutations introduced by TALEN pair TaSBEIIa_T01

SEQ ID NO: 7230 - DNA, 465 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctttcggagccatcttgactaccggtaatgcctacccgctactttcgctcattttgaattaaggtccttcgtcatgcaaatttggggaacatcaaagagtacaaagactagggaccactatttcttacagttcccctcatggtctgagaatatgctggga

SEQ ID NO: 7231 - DNA, 447 bp, Artificial; identical to SEQ ID NO: 7191
  TaSBEIIa  allele with mutations introduced by TALEN pair TaSBEIIa_T01

SEQ ID NO: 7232 - DNA, 419 bp, Artificial
  TaSBEIIa  allele with mutations introduced by TALEN pair TaSBEIIa_T01
  misc_feature (193): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgnggaaacaatcactgatggtgtaaccaaaggagttaaggaactagtcgcgggggagaaaccgcgagttgtcccaaaaccaggagatgggcagaaaatatacgagataatttcgctcattttgaattaaggtccttttcatcatgcaaatttggggaacatcaaagaggcaaagactagggaccactatttcatacagttcccctcatggtctgagaatatgctggga

SEQ ID NO: 7233 - DNA, 459 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgattttcggagccatcttgactaccggtaatgcctacccgctgctttcgctcattttgaattaaggtcctttcatcatgcaaatttggggaacatcaaagagacaaagctagggaccaccatttcatacagactcccctcgtggtctgagaatatgctggga

SEQ ID NO: 7234 - DNA, 342 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaatcatcatgcaaatttggggaacatcaaaagagacaaaagactagggaccaccatttcatacagatcccctcgtggtctgagaatatgctggga

SEQ ID NO: 7235 - DNA, 457 bp, Artificial; identical to SEQ ID NO: 6806
  TaSBEIIa  allele with mutations introduced by TALEN pair TaSBEIIa_T01

SEQ ID NO: 7236 - DNA, 429 bp, Artificial; identical to SEQ ID NO: 6160
  TaSBEIIa  allele with mutations introduced by TALEN pair TaSBEIIa_T01

SEQ ID NO: 7237 - DNA, 394 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagactttcgctcattttgaattaaggtcctttcgtcatgcaaatttggggaacatcaaagagacaaagactagggaccactatttcttacagttcccctcatggtctgagaatatgctggga

SEQ ID NO: 7238 - DNA, 404 bp, Artificial; identical to SEQ ID NO: 6960
  TaSBEIIa  allele with mutations introduced by TALEN pair TaSBEIIa_T01

SEQ ID NO: 7239 - DNA, 377 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcctttcgctcattttgaattaaggtcctttcgtcatgcaaatttgggaacatcaaagagacaaagactagggaccactattcttacagttcccctcatggtctgagaatatgctggga

SEQ ID NO: 7240 - DNA, 359 bp, Artificial
  TaSBEIIa  allele with mutations introduced by TALEN pair TaSBEIIa_T01
tcagatgggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcaactgatggtgtaaccaaaggagttaaggaactagtcgtgggggagaaaccgcgagaattaaggtcctttcgtcatgcaaatttggggaacatcaaagagacaaagactagggaccactatttcttacagttccctcatggtctgagaatatgctgga

SEQ ID NO: 7241 - DNA, 442 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattctgactaccggtaatgcctaccgctactttcgctcattttgaattaaggtcctttcgtcatgcaaatttggggaacatcaaagagacaaagactagggaccactatttcttacagttcccctcatggtctgagaatatgctgggga

SEQ ID NO: 7242 - DNA, 423 bp, Artificial; identical to SEQ ID NO: 7211
  TaSBEIIa  allele with mutations introduced by TALEN pair TaSBEIIa_T01

SEQ ID NO: 7243 - DNA, 439 bp, Artificial; identical to SEQ ID NO: 6214
  TaSBEIIa  allele with mutations introduced by TALEN pair TaSBEIIa_T01

SEQ ID NO: 7244 - DNA, 424 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccgctgctttcgctcattttgaattaaggtcctttcatcatgcaaatttggggaacatcaaagagacaaagactagggaccaccatttcatacagatcccctgtggtctgagaatatgctggga

SEQ ID NO: 7245 - DNA, 437 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagctaccggtaatgcctacccgctgctttcgctcattttgaattaaggtccttttcatcatgcaaatttggggaacatcaaagagacaaagactagggaccaccatttcatacagatcccctcgtggtctgagaatatgctggga

SEQ ID NO: 7246 - DNA, 455 bp, Artificial
  TaSBEIIa  allele with mutations introduced by TALEN pair TaSBEIIa_T01
  misc_feature (394): n is a or c or t or g
tcagatggatgtgcattctagcaagaacttcacaacataatgcatcgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattttcggagccatcttgactaccggtaatgcctacccgctgctttcgctcattttgaattaaggtcctttcatcatgcaaatttggggaacatcaaagngacaaagactagggaccaccatttcatacagatcccctcgtggtctgagaatatgctggga

SEQ ID NO: 7247 - DNA, 445 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattcttgactaccggtaatgcctacccgctaatttcgctcattttgaattaaggtcctttcatcatgcaaatttggggaacatcaaagaggcaaagactagggaccactattcatacagttcccctcatggtctgagaatatgctggga

SEQ ID NO: 7248 - DNA, 337 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagtcaaatttggggaacatcaaagagacaaagactagggaccactattcttacagttccctcatggtctgagaatatgctggga

SEQ ID NO: 7249 - DNA, 448 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaaccaggagatgggcagaaaataaagattttcggagccatcttgactaccggtaatgcctaccgctacttcgctcattttgtaattaaggtcctttcgttcatgcaaatttgggaacatcaaagagacaaagactagggaccactattcttacagttccctcatggtctgagaatatgctgga

SEQ ID NO: 7250 - DNA, 430 bp, Artificial
  TaSBEIIa  allele with mutations introduced by TALEN pair TaSBEIIa_T01
tcagatggatgtgcattctaagcaagaacttcacaacataatgcaccgtttgggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacatgcctacccgctgctttcgctcattttgaattaaggtccttttcatcatgcaaattttgggggaacatcaaaagagacaaagactagggaccaccatttcatacagatcccctcgtggtctgagaatatgctggga

SEQ ID NO: 7251 - DNA, 427 bp, Artificial; identical to SEQ ID NO: 6346
  TaSBEIIa  allele with mutations introduced by TALEN pair TaSBEIIa_T01

SEQ ID NO: 7252 - DNA, 447 bp, Artificial
  TaSBEIIa  allele with mutations introduced by TALEN pair TaSBEIIa_T01
  misc_feature (425): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccaacgctgaaagataatgcctacccgctactttcgctcattttgaattaaggtcctttcgtcatgcaaatttggggaacatcaaagagacaaagactagggaccactattcttacagttcccctnatggtctgagaatatgctggga

SEQ ID NO: 7253 - DNA, 450 bp, Artificial
  TaSBEIIa  allele with mutations introduced by TALEN pair TaSBEIIa_T01
  misc_feature (362): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctacccgctgctttcgctcattttgaattaaggtcctttnatcatgcaaatttggggaacatcaaagagacaaagactaggaccaccatttcatacagatcccctcgtggtctgagaatatgctggga

SEQ ID NO: 7254 - DNA, 451 bp, Artificial
  TaSBEIIa  allele with mutations introduced by TALEN pair TaSBEIIa_T01
tcagatggatgtgcattctagcaagaacttcacgaaaataatgcactgtttgtggtttcgttagtctgctctacaattgctattttcgtgctgtagatacctgaagacatcgaggagcaaacggctgaagtaaacatgacagggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacgagattgacccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7255 - DNA, 428 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatctaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7256 - DNA, 414 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacccgctactttcgctcattttgaattaaggtcctttcgtcatgcaaatttggggaacatcaaagagacaaagactagggaccactatttctacagttcccctcatggtctgagaatatgctggga

SEQ ID NO: 7257 - DNA, 415 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtgggggagaaaccgcgagttgtcccaaaaccaggagatgggcagaaaatatacccgctactttcgctcattttgaattaaggtcctttcgtcatgcaaatttggggaacatcaaagagacaaagactagggaccactatttcttacagttcccctcatggtctgagaatatgctggga

SEQ ID NO: 7258 - DNA, 399 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgatttcgctcattttgaattaaggtcctttcatcatgcaaattttggggaacatcaaagaggcaaagactagggaccactatttcatacagttcccctcatggtctgagaatatgctggga

SEQ ID NO: 7259 - DNA, 448 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaaatatacgagattgacccaacgctaccggtaatgcctaccgctaatttcgctcattttgaattaaggtcctttcatcatgcaaatttggggaaacatcaaagaggcaaagactagggaccactatttcatacagtccctcatggtctgagaatatgctggga

SEQ ID NO: 7260 - DNA, 342 bp, Artificial
  TaSBEIIa  allele with mutations introduced by TALEN pair TaSBEIIa_T01
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggaaacaatcactgatggtgtaaccaaaggagttaaggaactagtcgtggggagaaaccgcgagttgtccaaatttggggaacatcaaagagacaaagactagggaccactatttcttacagttcccctcatggtctgagaatatgctggga

SEQ ID NO: 7261 - DNA, 450 bp, Artificial; identical to SEQ ID NO: 6343
  TaSBEIIa  allele with mutations introduced by TALEN pair TaSBEIIa_T01

SEQ ID NO: 7262 - DNA, 453 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaggagttaaggaactagtcgtgggggagaaaccgcgagttgtcccaaaaccaggagatgggcagaaaatatacgagattttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7263 - DNA, 450 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgaatggtgtaaccaaaggagttaaggaactagtcgtgggggagaaaccgcgagttgtcccaaaaccaggagatgggcagaaaatatacgagattgacccatcttgactaccggtaatgcctacccgctgctttcgctcattttgaattaaggtcctttcatcatgcaaatttgggaacatcaaagagacaaagactagggaccaccatttcatacagatcccctcgtggtctgagatatgctggga

SEQ ID NO: 7264 - DNA, 395 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaggagttaaggaactagtcgtgggggagaaaccgcgagttgtcccaaaacctacccgctgctttcgctcattttgaattaaggtcctttcatcatgcaaatttggggaacatcaaagagacaaagactagggaccaccatttcatacagatcccctgtggtctgagaatatgctggga

SEQ ID NO: 7265 - DNA, 377 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtacccaaaaccaattaaggtcctttcatcatgcaaatttggggaacatcaaaagaggcaaagactagggaccactatttcatacagttcccctcatggtctgagaatatgctggga

SEQ ID NO: 7266 - DNA, 416 bp, Artificial; identical to SEQ ID NO: 6584
  TaSBEIIa  allele with mutations introduced by TALEN pair TaSBEIIa_T01

SEQ ID NO: 7267 - DNA, 449 bp, Artificial
  TaSBEIIa  allele with mutations introduced by TALEN pair TaSBEIIa_T01
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtggaaacaatcactgatggtgtaaccaaaggagttaaggaactagtcgcgggggagaaaccgcgagttgtcccaaaaccaggagatgggcagaaatttcggagccatcttgactaccggtaatgcctacccgctaatttcgctcattttgaattaaggtcctttcatcatgcaaaatttggggaacatcaaagaggacaaagactagggaccactatttcatacagttcccctcactggtctgagaatatgctggga

SEQ ID NO: 7268 - DNA, 455 bp, Artificial
  TaSBEIIa  allele with mutations introduced by TALEN pair TaSBEIIa_T01
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtggaaacaatcactgatggtgtaaccaaaggagttaaggaactagtcgtgggggagaaaccgcgagttgtcccaaaaccaggagatgggcagaaaatatacgagatttcggagccatcttgactaccggtaatgcctacccgctgctttcgctcattttgaatttaaggtcctttcatcatgcaaatttggggaacatcaaagagacaaagactagggaccaccatttcatacagatcccctcgtggtctgagaatatgctggga

SEQ ID NO: 7269 - DNA, 460 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7270 - DNA, 451 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7271 - DNA, 471 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcactggtctgagaatatgctggga

SEQ ID NO: 7272 - DNA, 467 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 7273 - DNA, 507 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgccaggcccacggcttgaccccccagcaggtggtggccaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7274 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcatttgaattaaggtcctttcgtcatgcaaatttggggaacatcaaagagacaaagactagggaccactattcttacagttcccctcatggtctgagaatatgctggga

SEQ ID NO: 7275 - DNA, 460 bp, Artificial
  TaSBEIIa allele with mutations introduced by TALEN pair TaSBEIIa_T02
  misc_feature (232): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7276 - DNA, 458 bp, Artificial
  TaSBEIIa allele with mutations introduced by TALEN pair TaSBEIIa_T02
  misc_feature (232): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttccctcatggtctgagaatatgctggga

SEQ ID NO: 7277 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgacacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7278 - DNA, 468 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataatcactgatggtgtaaccaaaggagttaaggaactagtcgcgggggagaaaccgcgagttgtcccaaaaccaggagatgggcagaaaatatacgagattgacccaacgctgaaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7279 - DNA, 468 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 7280 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgcggtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7281 - DNA, 471 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggacaaagactagggaccactatttcatacagttcccctcatggtctgagaatatgctggga

SEQ ID NO: 7282 - DNA, 467 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatacaaagagacaaagactagggaccaccatttcatacagatcccctcgtggtctgagaatatgctggga

SEQ ID NO: 7283 - DNA, 446 bp, Artificial
  TaSBEIIa allele with mutations introduced by TALEN pair TaSBEIIa_T02
  misc_feature (218): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattggagttaaggaactagtcgcggggganaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7284 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtccttcgtcatgcaaatttggggaacatcaaagagacaaagactagggaccactatttcttacagttcccctcatggtctgagaatatgctggga

SEQ ID NO: 7285 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7286 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagatatgctggga

SEQ ID NO: 7287 - DNA, 469 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7288 - DNA, 507 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgccaggcccacggcttgaccccccagcaggtggtggccaaacaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctaacccgctactttcgctcattttgaattaaaggtcctttcgtcatgcaaatttggggaacatcaaagagacaaagactagggaccactatttcttacagttccctcatggtctgagaatatgactgga

SEQ ID NO: 7289 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctgga

SEQ ID NO: 7290 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7291 - DNA, 470 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7292 - DNA, 507 bp, Artificial
  TaSBEIIa allele with mutations introduced by TALEN pair TaSBEIIa_T02
tcagatggatgtgcattctagcaagaacttcacaaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgccaggcccacggcttgaccccccagcaggtggtggccaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7293 - DNA, 468 bp, Artificial
  TaSBEIIa allele with mutations introduced by TALEN pair TaSBEIIa_T02
  misc_feature (240): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattacgaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7294 - DNA, 444 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattggagttaaggaactagtcgcgggggagaaaccgcgagttgtcccaaaaaccaggagatgggcagaaaatatacgagattgacccaacgctgaaagatttcggagccatcttgactaccggtaatgcctaccgctaatttcgctcattttgaattaaggtcctttcatcatgcaaatttgggaacatcaaagaggcaaagactagggaccactatttcatacagttcccctcatggtctgagaatatgctggga

SEQ ID NO: 7295 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactattcttacagttcccctcatggtctgagaatatgctggga

SEQ ID NO: 7296 - DNA, 467 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7297 - DNA, 474 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtaaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7298 - DNA, 467 bp, Artificial
  TaSBEIIa allele with mutations introduced by TALEN pair TaSBEIIa_T02
  misc_feature (444): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctaccgctaatttcgctcattttgaattaaggtcctttcatcatgcaaatttggggaacatcaaagaggcaaagactagggaccactatttcatacagttccccncatggtctgagaatatgctggga

SEQ ID NO: 7299 - DNA, 466 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgttcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7300 - DNA, 469 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaatttggggaacatcaaagaggcaaagactagggaccactatttcatacagttcccctcatggtctgagaatatgctggga

SEQ ID NO: 7301 - DNA, 465 bp, Artificial
  TaSBEIIa allele with mutations introduced by TALEN pair TaSBEIIa_T02
tcagtggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7302 - DNA, 466 bp, Artificial
  TaSBEIIa allele with mutations introduced by TALEN pair TaSBEIIa_T02
  misc_feature (238): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7303 - DNA, 460 bp, Artificial; identical to SEQ ID NO: 7269
  TaSBEIIa allele with mutations introduced by TALEN pair TaSBEIIa_T02

SEQ ID NO: 7304 - DNA, 463 bp, Artificial
  TaSBEIIa allele with mutations introduced by TALEN pair TaSBEIIa_T02
tcagatggatgtgcttctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7305 - DNA, 518 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgacacacgcgcacatcgttgcgttaagccaacacccggcagcgttatcggatcccgggccaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcattttgaattaaggtcctttcgtcatgcaaatttggggaacatcaaagagacaaagactagggaccactatttcttacagttcccctcatggtctgagaat

SEQ ID NO: 7306 - DNA, 461 bp, Artificial
  TaSBEIIa allele with mutations introduced by TALEN pair TaSBEIIa_T02
  misc_feature (232): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactaggggaccactatttcttacagttcccctcatggtctgagaatatgctggga

SEQ ID NO: 7307 - DNA, 464 bp, Artificial
  TaSBEIIa allele with mutations introduced by TALEN pair TaSBEIIa_T02
  misc_feature (237): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7308 - DNA, 464 bp, Artificial
  TaSBEIIa allele with mutations introduced by TALEN pair TaSBEIIa_T02
  misc_feature (237): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7309 - DNA, 463 bp, Artificial
  TaSBEIIa allele with mutations introduced by TALEN pair TaSBEIIa_T02
  misc_feature (237): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaatcactgatggtgtaaccaaaggagttaaggaactagtcgtggggganaaaccgcgagttgtcccaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7310 - DNA, 461 bp, Artificial
  TaSBEIIa allele with mutations introduced by TALEN pair TaSBEIIa_T02
  misc_feature (232): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcattgcaaatttggggaacatcaaagagacaaagactagggaccactatttcttacagttcccctcatggtctgagaatatgctggga

SEQ ID NO: 7311 - DNA, 462 bp, Artificial
  TaSBEIIa allele with mutations introduced by TALEN pair TaSBEIIa_T02
  misc_feature (237): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttgggaacatcaaagagacaaagactagggaccactattcttacagttcccctcatggtctgagaatatgctggga

SEQ ID NO: 7312 - DNA, 463 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatcactgatggtgtaaccaaaggagttaaggaactagtcgcgggggagaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7313 - DNA, 466 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcatacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctaccgctaatttcgctcattttgaattaaggtcctttcatcatgcaaatttggggaacatcaaagaggcaaagactagggaccactatttcatacagttcccctcatggtctgagaatatgctggga

SEQ ID NO: 7314 - DNA, 505 bp, Artificial
  TaSBEIIa allele with mutations introduced by TALEN pair TaSBEIIa_T02
  misc_feature (491): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcgtgtaaccaaaggagttaaggaactagtcgtgggggagaaaccgcgagttgtacccaaaaccaggagatgggcagaaaatatacgagattgacccaacgctagaaagtatttcggagccatcttgactaccggtaatgcctacccgctacttcgctcatttnaattagtctttccg

SEQ ID NO: 7315 - DNA, 464 bp, Artificial
  TaSBEIIa allele with mutations introduced by TALEN pair TaSBEIIa_T02
  misc_feature (238): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttccctcatggtctgagaatatgctggga

SEQ ID NO: 7316 - DNA, 451 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaacaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7317 - DNA, 469 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaaatttcgctcattttgaattaaggtcctttcatcatgcaaatttggggaacatcaaagaggcaaagactagggaccactattcatacagttcccctcatggtctgagaatatgctggga

SEQ ID NO: 7318 - DNA, 496 bp, Artificial
  TaSBEIIa allele with mutations introduced by TALEN pair TaSBEIIa_T02
  misc_feature (484): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggtggaggcagtgcatgcatggcgcaatgcactgacgggtgccccgctaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcatttgaattaaggtcctttcgtcatgcaaatttgggaacatcaaagagacaaagactagggacactatttcttacngttccctcatgt

SEQ ID NO: 7319 - DNA, 467 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattacaatcactgatggtgtaaccaaaggagttaaggaactagtcgtgggggagaaaccgcgagttgtcccaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7320 - DNA, 460 bp, Artificial; identical to SEQ ID NO: 7275
  TaSBEIIa allele with mutations introduced by TALEN pair TaSBEIIa_T02
  misc_feature (232): n is a or c or t or g

SEQ ID NO: 7321 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactaggaccactattcttacagttcccctcatggtctgagaatatgctggga

SEQ ID NO: 7322 - DNA, 466 bp, Artificial; identical to SEQ ID NO: 7299
  TaSBEIIa allele with mutations introduced by TALEN pair TaSBEIIa_T02

SEQ ID NO: 7323 - DNA, 466 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatacaaagaggacaaagactagggaccactatttcatacagttcccctcatggtctgagaatatgctggga

SEQ ID NO: 7324 - DNA, 520 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgacacacgcgcacatcgttgcgttaagccaacacccggcagcgttatcggatcccgggccaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaatttaaggtcctttcgtcatgcaaatttggggaacatcaaagagacaaagactagggaccactatttcttacagttcccctcatggtctgagaat

SEQ ID NO: 7325 - DNA, 456 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgacacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgattaaggtcctttcgtcatgcaaatttggggaacatcaaagagacaaagactagggaccactatttcttacagttcccctcatggtctgagaatatgctggga

SEQ ID NO: 7326 - DNA, 467 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtactgagaatatgctggga

SEQ ID NO: 7327 - DNA, 467 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7328 - DNA, 461 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 7329 - DNA, 467 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctaccgctaatttcgctcattttgaattaaggtcctttcatcatgcaaatttggggaacatcaaagaggcaaagactagggaccactatttcatacagttcccctcatggtctgagaatatgctggga

SEQ ID NO: 7330 - DNA, 468 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7331 - DNA, 470 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7332 - DNA, 459 bp, Artificial
  TaSBEIIa allele with mutations introduced by TALEN pair TaSBEIIa_T02
  misc_feature (232): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactaggggaccactattcttacagttcccctcatggtctgagaatatgctggga

SEQ ID NO: 7333 - DNA, 468 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7334 - DNA, 468 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttttcgtcatgcaaatttggggaacatcaaagagacaaagactagggaccactatttcttacagttcccctcatggtctgagaatatgctggga

SEQ ID NO: 7335 - DNA, 467 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttttcgtcatgcaaatttggggaacatcaaagagacaaagactagggaccactatttcttacagttcccctcatggtctgagaatatgctggga

SEQ ID NO: 7336 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaataaggtccttcgtcatgcaaatttggggaacatcaaagagacaaagactagggaccactatttcttacagttcccctcatggtctgagaatatcgctggga

SEQ ID NO: 7337 - DNA, 470 bp, Artificial; identical to SEQ ID NO: 7331
  TaSBEIIa allele with mutations introduced by TALEN pair TaSBEIIa_T02

SEQ ID NO: 7338 - DNA, 503 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcgcgccacatagcagaactttaaaagtgctcatcattggaaaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcattcatgcaaatttggggaacatcaaagaggcaaagactagggaccactattcatacagttcccctcatggtctgagaatatgctggga

SEQ ID NO: 7339 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7340 - DNA, 465 bp, Artificial
  TaSBEIIa allele with mutations introduced by TALEN pair TaSBEIIa_T02
  misc_feature (458): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatangctggga

SEQ ID NO: 7341 - DNA, 471 bp, Artificial; identical to SEQ ID NO: 7281
  TaSBEIIa allele with mutations introduced by TALEN pair TaSBEIIa_T02

SEQ ID NO: 7342 - DNA, 469 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7343 - DNA, 466 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7344 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7345 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7346 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7347 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatcactgatggtgtaaccaaggagttaaggaactagtcgtgggggagaaaccgcgagttgtcccaaaaccaggagatgggcagaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagatatgctggga

SEQ ID NO: 7348 - DNA, 466 bp, Artificial
  TaSBEIIa allele with mutations introduced by TALEN pair TaSBEIIa_T02
  misc_feature (215): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataatcactgatggtgtaaccaaaggngttaaggaactagtcgcgggggagaaaccgcgagttgtcccaaaaccaggagatgggcagaaaatatacgagattgacccaacgctgaaagattttcggaagccatcttgactaccggtaatgcctaccgctaatttcgctcatttgaattaaggtcctttcatcatgcaaatttggggaacatcaaagaggcaaagactagggaccactatttcatacagttcccctcatggtctgagaatatgctggga

SEQ ID NO: 7349 - DNA, 466 bp, Artificial
  TaSBEIIa allele with mutations introduced by TALEN pair TaSBEIIa_T02
  misc_feature (216): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaacaatcactgatggtgtaaccaaaggngttaaggaactagtcgtgggggagaaaccgcgagttgtcccaaaaccaggagatgggcagaaaatatacgagattgacccaagctgaaagattttcggagccatcttgactaccggtaatgcctacccgctactttcgctcattttgaattaaggtccttcgtcatgcaaatttggggaacatcaaagagacaaagactagggaccactatttcttacagttcccctcatggtctgagaatatgctggga

SEQ ID NO: 7350 - DNA, 468 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7351 - DNA, 507 bp, Artificial; identical to SEQ ID NO: 7273
  TaSBEIIa allele with mutations introduced by TALEN pair TaSBEIIa_T02

SEQ ID NO: 7352 - DNA, 465 bp, Artificial
  TaSBEIIa allele with mutations introduced by TALEN pair TaSBEIIa_T02
tcagatggatgtgcattctagcaagaacttcacaaaataatgcactgtttgtggtttcgttagtctgctctacaattgctatttttgtgctgtagatacctgaagacatcgaggagcaaacggctgaagtaaacatgacaggggggactgcagaaaaacttgaatcttcagaaccgactcaaggcattacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 7353 - DNA, 460 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcattttgaattaaggtcctttcgtcatgcaaatttgggaacatcaaagagacaaagactagggaccactattctacagttccctcatggtctgagaatatgctgga

SEQ ID NO: 7354 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcattgcaaatttggggaacatcaaagagacaaagactagggaccactattcttacagttcccctcatggtctgagaatatgctggga

SEQ ID NO: 7355 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatcactgatggtgtaaccaaaggagttaaggaactagtcgtgggggagaaaccgcgagttgtcccaaaaccaggagatgggcagaaaatatacgagattgacccaagctgaaagattttcggagccatcttgactaccggtaatggcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7356 - DNA, 467 bp, Artificial
  TaSBEIIa allele with mutations introduced by TALEN pair TaSBEIIa_T02
  misc_feature (239): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7357 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7358 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 7359 - DNA, 471 bp, Artificial
  TaSBEIIa allele with mutations introduced by TALEN pair TaSBEIIa_T02
  misc_feature (449): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctnatggtctgagaatatgctggga

SEQ ID NO: 7360 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7361 - DNA, 465 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgttcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctaccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7362 - DNA, 465 bp, Artificial
  TaSBEIIa allele with mutations introduced by TALEN pair TaSBEIIa_T02
  misc_feature (237): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaatcactgatggtgtaaccaaaggagttaaggaactagtcgtggggganaaaccgcgagttgtcccaaaaccaggagatgggcagaaaatatacgagattgacccaacgctgaaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7363 - DNA, 518 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcacgaaccccccgttcagcccgaccgctgcgccttatccggtaactaaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggacaaagactagggaccactattcatacagttcccctcatggtctgagatatgctggga

SEQ ID NO: 7364 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtccttcgtcatgcaaatttgggaacatcaaagagacaaagactagggaccactattcttacagttcccctcatggtctgagaatatgctggga

SEQ ID NO: 7365 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagaacaaagactagggaccactattcttacagttcccctcatggtctgagaatatgctgga

SEQ ID NO: 7366 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactatttcttacagttcccctcatggtctgagaatatgctggga

SEQ ID NO: 7367 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgcttcattttgaattaaggtcctttcgtcatgcaaatttgggaacatcaaagagacaaagactagggaccactatttcttacagttccctcatggtctgagaatatgctggga

SEQ ID NO: 7368 - DNA, 470 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgaacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7369 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7370 - DNA, 457 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7371 - DNA, 470 bp, Artificial
  TaSBEIIa allele with mutations introduced by TALEN pair TaSBEIIa_T02
  misc_feature (448): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctnatggtctgagaatatgctggga

SEQ ID NO: 7372 - DNA, 469 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactattcatacagttcccctcatggtctgagaatatgctggga

SEQ ID NO: 7373 - DNA, 518 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcacgaaccccccgttcagcccgaccgctgcgccttatccggtaactaaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactattcatacagttcccctcatggtctgagaatatgctggga

SEQ ID NO: 7374 - DNA, 468 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7375 - DNA, 471 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcaatcactgatggtgtaaccaaaggagttaaggaactagtcgcgggggagaaaccgcgagttgtcccaaaaccaggagatgggcagaaaatatacgagacttgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7376 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7377 - DNA, 469 bp, Artificial; identical to SEQ ID NO: 7342
  TaSBEIIa allele with mutations introduced by TALEN pair TaSBEIIa_T02

SEQ ID NO: 7378 - DNA, 467 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataacaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctaacccgctactttcgctcatttgaattaaggtcctttcgtcatgcaaatttgggaacatcaaagagaacaaagactagggaccactattcttacagttcccctcatggtctgagaatatgctggga

SEQ ID NO: 7379 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttccctcatggtctgagaatatgctggga

SEQ ID NO: 7380 - DNA, 465 bp, Artificial; identical to SEQ ID NO: 7339
  TaSBEIIa allele with mutations introduced by TALEN pair TaSBEIIa_T02

SEQ ID NO: 7381 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 7382 - DNA, 471 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctaccgctaatttcgctcattttgaattaaggtcctttcatcatgcaaatttggggaacatacaaagaggacaaagactagggaccactatttcatacagttcccctcatggtctgagaatatgctggga

SEQ ID NO: 7383 - DNA, 525 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgtcctgcgctggatgcagtgaaaaagggattgggggatcctatcagccgttcccagctggtgaagtccgagcggaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactaagggaccaactatttcttacagttcccctct

SEQ ID NO: 7384 - DNA, 462 bp, Artificial
  TaSBEIIa allele with mutations introduced by TALEN pair TaSBEIIa_T02
  misc_feature (234): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgctgatggtgtaaccaaaggagttaaggaactagtcgtggggganaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7385 - DNA, 502 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggtggaggcagtgcatgcatggcgcaatgcactgacgggtgccccgctaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggt

SEQ ID NO: 7386 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttgtcatgcaaatttggggaacatcaaagagacaaagactagggaccactatttcttacagttcccctcatggtctgagaatatgctggga

SEQ ID NO: 7387 - DNA, 467 bp, Artificial
  TaSBEIIa allele with mutations introduced by TALEN pair TaSBEIIa_T02
tcagatggatgtgcattctagcaagaacttcacgaaataatgcactgtttgtagtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcactggtctgagaatatgctggga

SEQ ID NO: 7388 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 7389 - DNA, 518 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcacgaacccccccgttcagcccgaccgctgcgccttatccggtaactaaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaatttggggaacatcaaagaggcaaagactagggaccactattcatacagttcccctcatggtctgagaatatgctggga

SEQ ID NO: 7390 - DNA, 466 bp, Artificial; identical to SEQ ID NO: 7290
  TaSBEIIa allele with mutations introduced by TALEN pair TaSBEIIa_T02

SEQ ID NO: 7391 - DNA, 467 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactattcttacagttcccctcatggtctgagaatatgctggga

SEQ ID NO: 7392 - DNA, 464 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggacaaagactagggaccactatttcatacagttcccctcatggtctgagaatatgctggga

SEQ ID NO: 7393 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgattaaggtcctttcgtcatgcaaatttgggaacatcaaagagacaaagactagggaccactattcttacagttcccctcatggtctgagaatatgctggga

SEQ ID NO: 7394 - DNA, 466 bp, Artificial; identical to SEQ ID NO: 7290
  TaSBEIIa allele with mutations introduced by TALEN pair TaSBEIIa_T02

SEQ ID NO: 7395 - DNA, 466 bp, Artificial; identical to SEQ ID NO: 7290
  TaSBEIIa allele with mutations introduced by TALEN pair TaSBEIIa_T02

SEQ ID NO: 7396 - DNA, 468 bp, Artificial
  TaSBEIIa allele with mutations introduced by TALEN pair TaSBEIIa_T02
tcagatggatgtgcattactagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7397 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaatcactgatggtgtaaccaaggagttaaggaactagtcgtgggggagaaaccgcgagttgtcccaaaaccaggagatgggcagaaaatatacgagattggcccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7398 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactaggacactattcttacagttcccctcatggtctgagaatatgctgga

SEQ ID NO: 7399 - DNA, 466 bp, Artificial
  TaSBEIIa allele with mutations introduced by TALEN pair TaSBEIIa_T02
tcagatggatgtgcattactagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7400 - DNA, 465 bp, Artificial
  TaSBEIIa allele with mutations introduced by TALEN pair TaSBEIIa_T02
  misc_feature (238): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7401 - DNA, 465 bp, Artificial
  TaSBEIIa allele with mutations introduced by TALEN pair TaSBEIIa_T02
  misc_feature (238): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7402 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7403 - DNA, 465 bp, Artificial
  TaSBEIIa allele with mutations introduced by TALEN pair TaSBEIIa_T02
  misc_feature (306): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatcactgatggtgtaaccaaaggagttaaggaactagtcgtgggggagaaaccgcgagttgtcccaaaaccaggagatgggcagaaaatatacgagattgacccaacgctgaaaagnttttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7404 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttccctcatggtctgagaatatgctggga

SEQ ID NO: 7405 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaacaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7406 - DNA, 468 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7407 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7408 - DNA, 450 bp, Artificial
  TaSBEIIa allele with mutations introduced by TALEN pair TaSBEIIa_T02
  misc_feature (223); (247): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaacaatcactgatggtgtaaccaaaggagttaaggaactagtcgtggggganaaaccgcgagttgtcccaaaaccnggagatgggcagaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7409 - DNA, 471 bp, Artificial
  TaSBEIIa allele with mutations introduced by TALEN pair TaSBEIIa_T02
  misc_feature (338); (350): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatnccggggtacccnctactttcgctcattttgaattaaggtcctttcgtcatgcaaatttggggaacatcaaagagacaaagactagggaccactattcttacagttcccctcatggtctgagaatatgctggga

SEQ ID NO: 7410 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttccctcatggtctgagaatatgctggga

SEQ ID NO: 7411 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttgggaacatcaaagagacaaagactagggaccactatttcttacagttcccctcatggtctgagaatatgctggga

SEQ ID NO: 7412 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataacaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctaacccgctactttcgctcattttgaattaaggtcctttcgtcatgcaaatttggggaacatcaaagagacaaagactaggaccactattcttacagttccctcatggtctgagaatatgctggga

SEQ ID NO: 7413 - DNA, 472 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7414 - DNA, 507 bp, Artificial; identical to SEQ ID NO: 7273
  TaSBEIIa allele with mutations introduced by TALEN pair TaSBEIIa_T02

SEQ ID NO: 7415 - DNA, 466 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcatacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattcatacagatcccctcgtggtctgagaatatgctggga

SEQ ID NO: 7416 - DNA, 507 bp, Artificial; identical to SEQ ID NO: 7273
  TaSBEIIa allele with mutations introduced by TALEN pair TaSBEIIa_T02

SEQ ID NO: 7417 - DNA, 465 bp, Artificial; identical to SEQ ID NO: 7360
  TaSBEIIa allele with mutations introduced by TALEN pair TaSBEIIa_T02

SEQ ID NO: 7418 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7419 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaatcactgatggtgtaaccaaaggagttaaggaactagtcgtgggggagaaaccgcgagttgtcccaaaaccaggagatgggcagaaaatatacgagattgacccaacgctgaaaagattttcggagccatcttgactaccggtaatgcctacccgctactttcgctcatttgaattaaggtccttcgtcatgcaaatttggggaacatcaaagagacaaagactagggaccactattcttacagttcccctcatggtctgagaatatgctggga

SEQ ID NO: 7420 - DNA, 468 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcatacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagactcccctcgtggtctgagaatatgctggga

SEQ ID NO: 7421 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaaacggctgaagtaaacatgacaggggggactgcagaaaaacttgaatcttcagaaccgactcaaggcattgtgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactaaggggaccactatttcttacagttcccctcatggtactgagatatgctggga

SEQ ID NO: 7422 - DNA, 470 bp, Artificial; identical to SEQ ID NO: 7368
  TaSBEIIa allele with mutations introduced by TALEN pair TaSBEIIa_T02

SEQ ID NO: 7423 - DNA, 507 bp, Artificial
  TaSBEIIa allele with mutations introduced by TALEN pair TaSBEIIa_T02
  misc_feature (485): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgccaggcccacggcttgaccccccagcaggtggtggccaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctnatggtctgagaatatgctggga

SEQ ID NO: 7424 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 7425 - DNA, 467 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctattttcgtgtgctgtagatacctgaagatatcgaggagcaaacggctgaagtgaacatgacaggggggaccgcagagaaacttgaatcttcagaaccgactcagggcattgatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctaccgctaatttcgctcattttgaattaaggtcctttcatcatgcaaatttggggaacatcaaagaggcaaagactagggaccactaatttcatacagttcccctcatggtctgagaatatgctggga

SEQ ID NO: 7426 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttgggaacatcaaagagacaaagactagggaccactattcttacagttcccctcatggtctgagaatatgctggga

SEQ ID NO: 7427 - DNA, 469 bp, Artificial; identical to SEQ ID NO: 7287
  TaSBEIIa allele with mutations introduced by TALEN pair TaSBEIIa_T02

SEQ ID NO: 7428 - DNA, 469 bp, Artificial; identical to SEQ ID NO: 7287
  TaSBEIIa allele with mutations introduced by TALEN pair TaSBEIIa_T02

SEQ ID NO: 7429 - DNA, 468 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcatttttgaattaaggtcctttcatcatgcaaatttggggaacatcaaagaggcaaagactagggaccactatttcatacagttcccctcatggtctgagaatatgctggga

SEQ ID NO: 7430 - DNA, 464 bp, Artificial
  TaSBEIIa allele with mutations introduced by TALEN pair TaSBEIIa_T02
tcagatggatgtgcattactagcaagaacttcacgaaataatgcgactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtccttcgtcatgcaaatttggggaacatcaaagagacaaagactagggaccactatttcttacagttcccctcatggtctgagaatatgctggga

SEQ ID NO: 7431 - DNA, 505 bp, Artificial
  TaSBEIIa allele with mutations introduced by TALEN pair TaSBEIIa_T02
  misc_feature (482): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcagcgttaagccaacacccggcagcgttagggaccgtcgctgtcaacaatcactgatggtgtaaccaaaggagttaaggaactagtcgtgggggagaaaccgcgagttgtcccaaaaccaggagatgggcagaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttctacagttccccncatggtctgagaatatgctggga

SEQ ID NO: 7432 - DNA, 469 bp, Artificial; identical to SEQ ID NO: 7372
  TaSBEIIa allele with mutations introduced by TALEN pair TaSBEIIa_T02

SEQ ID NO: 7433 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaatttgggaacatcaaagagacaaagactagggaccactatttcttacagttcccctcactggtctgagaatatgctggga

SEQ ID NO: 7434 - DNA, 451 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaacaatcactgatggtgtaaccaaaggagttaaggaactagtcgtgggggagaaaccgcgagttgtcccaaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7435 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcattttgaattaaggtcctttcgtcatgcaaatttggggaacatcaaagagacaaagactagggaccactattcttacagttcccctcatggtctgagaatatgctggga

SEQ ID NO: 7436 - DNA, 460 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgctaaatttgggaacatcaaagagacaaagactagggaccactatttcttacagttcccctcatggtctgagaatatgctggga

SEQ ID NO: 7437 - DNA, 506 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggtggaggcagtgcatgcatggcgcaatgcactgacgggtgccccgctaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaaacatacaaagagacaaagaactagggaccactatttcttacagttcccctcatggt

SEQ ID NO: 7438 - DNA, 507 bp, Artificial; identical to SEQ ID NO: 7273
  TaSBEIIa allele with mutations introduced by TALEN pair TaSBEIIa_T02

SEQ ID NO: 7439 - DNA, 459 bp, Artificial
  TaSBEIIa allele with mutations introduced by TALEN pair TaSBEIIa_T02
  misc_feature (239): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattacaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctacttcgctcatttgattaaggtccttcgtcatgcaaattgggaacatcaaagagacaaagactagggaccactattcttacagttccctcatggtctgagaatatgctggga

SEQ ID NO: 7440 - DNA, 457 bp, Artificial; identical to SEQ ID NO: 7277
  TaSBEIIa allele with mutations introduced by TALEN pair TaSBEIIa_T02

SEQ ID NO: 7441 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7442 - DNA, 465 bp, Artificial
  TaSBEIIa allele with mutations introduced by TALEN pair TaSBEIIa_T02
tcagatggatgtgcattctagcaagaacttcacgaaataatgcactgtttgtgtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatacaaagagacaaagactagggaccactatttcttacagttcccctcatggtctgagaatatgctggga

SEQ ID NO: 7443 - DNA, 465 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctaccgctaatttcgctcattttgaattaaggtcctttcatcatgcaaatttggggaacatcaaagaggcaaagactagggaccactatttcatacagttcccctcatggtctgagatatgctggga

SEQ ID NO: 7444 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactattcttacagttcccctcactggtctgagaatatgctggga

SEQ ID NO: 7445 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactattcttacagttcccctcatggtctgagaatatgctggga

SEQ ID NO: 7446 - DNA, 513 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatgccatccgtaagatgcttttctgtgactggtgagtactcaaccaagtcattaaaattcgtgcacacagcccagcttggagcgaacgacctacaccgaactgagatacctaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttacgtcatgcaatttgggaacatcaaagg

SEQ ID NO: 7447 - DNA, 467 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7448 - DNA, 465 bp, Artificial
  TaSBEIIa allele with mutations introduced by TALEN pair TaSBEIIa_T02
  misc_feature (236): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccccctcatggtctgagaatatgctggga

SEQ ID NO: 7449 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacatgaagacatcgaggagcaaacggctgaagtaaacatgacaggggggactgcagaaaaacttgaatcttcagaaccgactcaaggcaacaatcactgatggtgtaaccaaaggagttaaggaactagtcgtgggggagaaaccgcgagttgtcccaaaaccaggagatgggcagaaaatatacgagattgacccaacgctgaaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7450 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtccttcgtcatgcaaatttggggaacatcaaagagacaaagactagggaccactatttcttacagttccctcatggtctgagaatatgctgga

SEQ ID NO: 7451 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcaatgcaaatttgggaacatcaaagagacaaagactagggaccactattcttacagttcccctcatggtctgagaatatgctggga

SEQ ID NO: 7452 - DNA, 470 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattaaacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7453 - DNA, 497 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatagcaatattggtggcaagcaggcgctggagacggtgcaggcgctgttgccggtgctgtgccaggcccacggcttgacccccagcaggtggtggccatcgccagcaatggcgtggcaagcaggcgctggagacggtccagcgtgtaaccaaggagttaaggactagtcgtggggagaaaccgcgagttgtccaaaccaggagatgggcagaaatatacgagattggaccaacgctagaagatttcggagtccatcttgactaccggtaatgacctacccgctactttcgctcatttgattaaggtctttcg

SEQ ID NO: 7454 - DNA, 515 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgacacacgcgcacatcgttgcgttaagccaacacccggcagcgttatcggatcccgggccaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcatttgaattaaggtcctttcgtcatgcaaatttggggaacatcaaagagacaaagactagggaccactatttcttacagttcccctcatgtctgagat

SEQ ID NO: 7455 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagatatgctgga

SEQ ID NO: 7456 - DNA, 467 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagagcaaagactagggaccactatttcatacagttcccctcatggtctgagaatatgctggga

SEQ ID NO: 7457 - DNA, 467 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7458 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaaacaatcactgatggtgtaaccaaaggagttaaggaactagtcgtgggggagaaaccgcgagttgtcccaaaaccaggagatgggcagaaaatatacgagattgacccaacgctgaaaagattttcggagccatcttgactaccggtaatgcctacccgctactttcgctcattttgaattaaggtcctttcgtcatgcaaatttgggaacatcaaagagacaaagactaggaccactattcttacagttccctcatggtctgagaatatgctggga

SEQ ID NO: 7459 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7460 - DNA, 461 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttgggaacatcaaagagacaaagactagggaccactatttcttacagttcccctcatggtctgagatatgctggga

SEQ ID NO: 7461 - DNA, 471 bp, Artificial
  TaSBEIIa allele with mutations introduced by TALEN pair TaSBEIIa_T02
  misc_feature (153); (449): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccncagagaaacttgaatcttcagaaccgactcagggcattgcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcattacagttcccctnatggtctgagaatatgctggga

SEQ ID NO: 7462 - DNA, 468 bp, Artificial
  TaSBEIIa allele with mutations introduced by TALEN pair TaSBEIIa_T02
  misc_feature (242): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaaacaatcactgatggtgtaaccaaaggagttaaggaactagtcgtgggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggacactatttcttacagttcccctcatggtctgagaatatgctggga

SEQ ID NO: 7463 - DNA, 466 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgtcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagactcccctcgtggtctgagaatatgctggga

SEQ ID NO: 7464 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7465 - DNA, 471 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattaaacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccagtttcatacagatcccctcgtggtctgagaatatgctggga

SEQ ID NO: 7466 - DNA, 506 bp, Artificial
  TaSBEIIa allele with mutations introduced by TALEN pair TaSBEIIa_T02
  misc_feature (484): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgccaggcccacggcttgaccccccagcaggtggtggccaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcattttgaattaaggtcctttcgtcatgcaaatttggggaacatcaaagagacaaagactagggaccactatttcttacagttcccctnatggtctgagaatatgctggga

SEQ ID NO: 7467 - DNA, 463 bp, Artificial
  TaSBEIIa allele with mutations introduced by TALEN pair TaSBEIIa_T02
  misc_feature (262): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaatcactgatggtgtaaccaaaggagttaaggaactagtcgtgggggagaaaccgcgagttgtcccaaaaccnggagatgggcagaaaatatacgagattgacccaacgctgaaagattttcggagccatcttgactaccggtaatgcctaccgctactttcgctcatttgaattaaggtcctttcgtcatgcaaatttgggaacatcaaagagacaaagactagggaccactatttcttacagttcccctcatggtctgagaatatgctggga

SEQ ID NO: 7468 - DNA, 452 bp, Artificial
  TaSBEIIa allele with mutations introduced by TALEN pair TaSBEIIa_T02
  misc_feature (223): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaacaatcactgatggtgtaaccaaaggagttaaggaactagtcgtggggganaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7469 - DNA, 465 bp, Artificial
  TaSBEIIa allele with mutations introduced by TALEN pair TaSBEIIa_T02
tcagatggatgtgcattctagcaagaacttcacgaaataatgcactgtttgtgtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7470 - DNA, 458 bp, Artificial
  TaSBEIIa allele with mutations introduced by TALEN pair TaSBEIIa_T02
  misc_feature (232): n is a or c or t or g
tcagatggatgtgcattactagcaagaacttcacgaaataatgcactgtttgtggtttcgttagtctgctctacaattgctattttcgtgctgtagatacctgaagacatcgaggagcaaacggctgaagtaaacatgacagggggactgcagaaaaacttgaatcttcagaaccgactcaaggcattgtgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactattcttacagttcccctcatggtctgagaatatgctggga

SEQ ID NO: 7471 - DNA, 468 bp, Artificial; identical to SEQ ID NO: 7374
  TaSBEIIa allele with mutations introduced by TALEN pair TaSBEIIa_T02

SEQ ID NO: 7472 - DNA, 469 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcatacaatcactgatggtgtaaccaaaggagttaaggaactagtcgtgggggagaaaccgcgagttgtcccaaaaccaggagatgggcagaaaatatacgagattgacccaacactgaaaagattttcggagccatcttgactaccggtaatgcctacccgctgctttcgctcattttgaattaaggtcctttcatcatgcaaatttggggaacatacaaagagacaaagactagggaccaccatttcatacagatcccctcgtggtctgagaatatgctggga

SEQ ID NO: 7473 - DNA, 469 bp, Artificial
  TaSBEIIa allele with mutations introduced by TALEN pair TaSBEIIa_T02
tcagatggatgtgcattactagcaagaacttcacgaaataatgcgactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcataacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7474 - DNA, 468 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttttcgctcattttgaattaaggtccttttcgtcatgcaaatttggggaacatcaaagagacaaagactagggaccactatttcttacagttccctcatggtctgagaatatgctggga

SEQ ID NO: 7475 - DNA, 467 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcatacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7476 - DNA, 474 bp, Artificial
  TaSBEIIa allele with mutations introduced by TALEN pair TaSBEIIa_T02
tcagatggatgtgcattctagcaagaacttcacgaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgtaaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7477 - DNA, 465 bp, Artificial
  TaSBEIIa allele with mutations introduced by TALEN pair TaSBEIIa_T02
  misc_feature (443): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctaccgctaatttcgctcattttgaattaaggtcctttcatcatgcaaatttggggaacatcaaagaggcaaagactagggaccactattcatacagttcccctnatggtctgagaatatgctggga

SEQ ID NO: 7478 - DNA, 468 bp, Artificial; identical to SEQ ID NO: 7330
  TaSBEIIa allele with mutations introduced by TALEN pair TaSBEIIa_T02

SEQ ID NO: 7479 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaaacggctgaagtaaacatgacaggggggactgcagaaaaacttgaatcttcagaaccgactcaaggcataacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgctggga

SEQ ID NO: 7480 - DNA, 467 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactattcatacagttccctcatggtctgagaatatgctgga

SEQ ID NO: 7481 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7482 - DNA, 464 bp, Artificial; identical to SEQ ID NO: 7441
  TaSBEIIa allele with mutations introduced by TALEN pair TaSBEIIa_T02

SEQ ID NO: 7483 - DNA, 470 bp, Artificial; identical to SEQ ID NO: 7291
  TaSBEIIa allele with mutations introduced by TALEN pair TaSBEIIa_T02

SEQ ID NO: 7484 - DNA, 464 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggccaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactattcatacagttcccctcatggtctgagaatatgctggga

SEQ ID NO: 7485 - DNA, 471 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattaaacaatcactgatggtgtaaccaaaggagttaaggaactagtcgtgggggagaaaccgcgagttgtcccaaaaccaggagatgggcaagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7486 - DNA, 467 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcaatcactgatggtgtaaccaaaggagttaaggaactagtcgtgggggagaaaccgcgagttgtcccaaaaccaggagatgggcagaaaatatacgagattgacccaacgctgaaaagattttcggagccatcttgactaccggtaatgcctacccgctactttcgctcattttgaattaaggtccttttcgtcatgcaaatttggggaacatcaaagagacaaagactagggaccactatttcttacagttcccctcatggtctgagaatatgctggga

SEQ ID NO: 7487 - DNA, 464 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7488 - DNA, 466 bp, Artificial
  TaSBEIIa allele with mutations introduced by TALEN pair TaSBEIIa_T02
  misc_feature (238): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctacttcgctcatttgaattaaggtcctttcgtcatgctaaagtttgggaacatcaaagagaacaaagactagggaccactattcttacagttcccctcattggtctgagaatatgctggga

SEQ ID NO: 7489 - DNA, 497 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggtggaggcagtgcatgcatggcgcaatgcactgacgggtgcccgctaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcatttgaattaaggtcctttcgtcatgcaaatttggggaacatcaaagagacaaagactagggaccactattcttacagttcccctcatgt

SEQ ID NO: 7490 - DNA, 452 bp, Artificial; identical to SEQ ID NO: 7405
  TaSBEIIa allele with mutations introduced by TALEN pair TaSBEIIa_T02

SEQ ID NO: 7491 - DNA, 467 bp, Artificial; identical to SEQ ID NO: 7327
  TaSBEIIa allele with mutations introduced by TALEN pair TaSBEIIa_T02

SEQ ID NO: 7492 - DNA, 461 bp, Artificial
  TaSBEIIa allele with mutations introduced by TALEN pair TaSBEIIa_T02
  misc_feature (234); (438): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgctgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctaccgctaatttcgctcattttgaattaaggtcctttcatcatgcaaatttgggaacatcaaagaggcaaagactagggaccacgtatttcatacagttccccncatggtctgagaatatgctggga

SEQ ID NO: 7493 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgatgagcaaacggctgaagtaaacatgacaggggggactgcagaaaaacttgaatcttcagaaccgactcaaggcattgatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7494 - DNA, 499 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggtggaggcagtgcatgcatggcgcaatgcactgacgggtgccccgctaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcatttgaattaagtcctttcgtcatgcaaatttggggaacatcaaagagacaaagactagggaccactatttcttacagttcccctcatggt

SEQ ID NO: 7495 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7496 - DNA, 467 bp, Artificial; identical to SEQ ID NO: 7475
  TaSBEIIa allele with mutations introduced by TALEN pair TaSBEIIa_T02

SEQ ID NO: 7497 - DNA, 468 bp, Artificial; identical to SEQ ID NO: 7334
  TaSBEIIa allele with mutations introduced by TALEN pair TaSBEIIa_T02

SEQ ID NO: 7498 - DNA, 502 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgccaggcccacggcttgaccccccagcaggtggtggccaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaattgggaacatcaaagagacaaagactagggaccatatttcttacagttcccctcatggtctgagatatgctggga

SEQ ID NO: 7499 - DNA, 465 bp, Artificial; identical to SEQ ID NO: 7339
  TaSBEIIa allele with mutations introduced by TALEN pair TaSBEIIa_T02

SEQ ID NO: 7500 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctgga

SEQ ID NO: 7501 - DNA, 466 bp, Artificial; identical to SEQ ID NO: 7299
  TaSBEIIa allele with mutations introduced by TALEN pair TaSBEIIa_T02

SEQ ID NO: 7502 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttcccctcatggtctgagaatatgactggga

SEQ ID NO: 7503 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctacttcgctcattttgaattaaggtcctttcgtcatgcaaatttggggaacatcaaagagacaaagactagggaccactatttcttacagttcccctcatggtctgagaatatgctggga

SEQ ID NO: 7504 - DNA, 469 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtacctttcgtcatgcaaatttggggaacatcaaagagacaaagactagggaccactatttctacagttcccctcatggtctgagaatatgctggga

SEQ ID NO: 7505 - DNA, 455 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagatatgctggga

SEQ ID NO: 7506 - DNA, 462 bp, Artificial
  TaSBEIIa allele with mutations introduced by TALEN pair TaSBEIIa_T02
tcagatggatgtgcattctagcaagaacttcatgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatcactgatggtgtaaccaaaggagttaaggaactagtcgtgggggagaaaccgcgagttgtcccaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7507 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttgtcatgcaaatttgggaacatcaaagagacaaagactagggaccactatttctacagttcccctcatggtctgagaatatgctggga

SEQ ID NO: 7508 - DNA, 514 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatttagcagagcgaggtatgtaggcggtgctacagagttcttgaagtgaacaatcactgatggtgtaaccaaaggagttaaggaactagtcgtgggggagaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7509 - DNA, 466 bp, Artificial
  TaSBEIIa allele with mutations introduced by TALEN pair TaSBEIIa_T02
  misc_feature (377): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctaccgctaatttcgctcattttgaattaaggtcctttnatcatgcaaatttggggaacatcaaagagcaaagactagggaccactatttcatacagttcccctcatggtctgaagaatatgctggga

SEQ ID NO: 7510 - DNA, 449 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaacaatcactgatggtgtaaccaaaggagttaaggaactagtcgtgggggagaaaccgcgagttgtcccaaaacaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttccctcatggtctgagaatatgctggga

SEQ ID NO: 7511 - DNA, 465 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggccaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttgggaacatcaaagaggcaaagactagggaccactatttcatacagttcccctcatggtctgagaatatgctggga

SEQ ID NO: 7512 - DNA, 507 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgccaggcccacggcttgaccccccagcaggtggtggccaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcattttgaattaaggtcctttcgtcatgcaaatttggggaacatacaaagagacaaagactagggaccactatttcttacagttcccctcatggtctgagaatatgctggga

SEQ ID NO: 7513 - DNA, 519 bp, Artificial
  TaSBEIIa allele with mutations introduced by TALEN pair TaSBEIIa_T02
  misc_feature (317): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgtcctgcgctggatgcagtgaaaaagggattgggggatcctatcagccgttcccagctggtgaagtccgagcggaaacaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctacttcgctcatttgtaattaaggtcctttcgtcatgcaaattagggtaacgatacaaagaagacaaagaactaggaaccactattcttacagtt

SEQ ID NO: 7514 - DNA, 472 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcaatcactgatggtgtaaccaaaggagttaaggaactagtcgcgggggagaaaccgcgagttgtcccaaaaccaggagatgggacagaaaatatacgagattgacccaacgctgaaagattttcggagccatcttgactaccggtaatgcctacccgctaatttcgctcattttgaattaaggtcctttcatcatgcaaatttggggaacatcaaagaggacaaagactagggaccactatttcatacagttcccctcatggtctgagaatatgctggga

SEQ ID NO: 7515 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgatgagcaaacggctgaagtaaacatgacaggggggactgcagaaaaacttgaatcttcagaaccgactcaaggcattgatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttcttacagttcccctcatggtctgagaatatgctggga

SEQ ID NO: 7516 - DNA, 465 bp, Artificial
  TaSBEIIa allele with mutations introduced by TALEN pair TaSBEIIa_T02
  misc_feature (239): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattacaatcactgatggtgtaaccaaaggagttaaggaactagtcgtggggganaaaccgcgagttgtcccaaaaccaggagatgggcaagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttccctcatggtctgagaatatgctggga

SEQ ID NO: 7517 - DNA, 465 bp, Artificial
  TaSBEIIa allele with mutations introduced by TALEN pair TaSBEIIa_T02
  misc_feature (238): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgttcactgatggtgtaaccaaaggagttaaggaactagtcgtggggganaaaccgcgagttgtcccaaaaccaggagatgggcagaaaatatacgagattgacccaacactgaaagattttcggagccatcttgactaccggtaatgcctacccgctgctttcgctcatttgaattaaggtcctttcatcatgcaaatttggggaacatcaaagagacaaagactagggaccaccatttcatacagatcccctcgtggtctgagaatatgctggga

SEQ ID NO: 7518 - DNA, 469 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtccttttcgtcatgcaaatttgggaacatcaaagagacaaagactagggaccactatttcttacagttcccctcatggtctgagaatatgctggga

SEQ ID NO: 7519 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaatttgggaacatcaaagagacaaagactagggaccactattcttacagttcccctcatggtctgagaatatgctggga

SEQ ID NO: 7520 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattggggaacatcaaagagacaaagactagggaccactatttcttacagttcccctcatggtctgagaatatgctggga

SEQ ID NO: 7521 - DNA, 463 bp, Artificial
  TaSBEIIa allele with mutations introduced by TALEN pair TaSBEIIa_T02
  misc_feature (236): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagagacaaagactagggaccactatttcttacagttcccctcatggtctgagaatatgctggga

SEQ ID NO: 7522 - DNA, 464 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcatacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctaccgctgctttcgctcattttgaattaaggtcctttcatcatgcaatttggggaacatcaaagagacaaagactagggacaccatttcatacagatcccctcgtggtctgagaatatgctggga

SEQ ID NO: 7523 - DNA, 468 bp, Artificial; identical to SEQ ID NO: 7333
  TaSBEIIa allele with mutations introduced by TALEN pair TaSBEIIa_T02

SEQ ID NO: 7524 - DNA, 467 bp, Artificial; identical to SEQ ID NO: 7475
  TaSBEIIa allele with mutations introduced by TALEN pair TaSBEIIa_T02

SEQ ID NO: 7525 - DNA, 470 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattaacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactattcatacagttcccctcatggtctgagaatatgctggga

SEQ ID NO: 7526 - DNA, 466 bp, Artificial; identical to SEQ ID NO: 7418
  TaSBEIIa allele with mutations introduced by TALEN pair TaSBEIIa_T02

SEQ ID NO: 7527 - DNA, 506 bp, Artificial
  TaSBEIIa allele with mutations introduced by TALEN pair TaSBEIIa_T02
  misc_feature (304): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgccaggcccacggcttgaccccccagcaggtggtggccaaacaatcactgatggtgtaaccaaaggagttaaggaactagtcgtgggggagaaaccgcgagttgtcccaaaaaccnggagatgggcagaaaaatatacgagattgacccaacgctgaaagattttcggagccatcttgactaccggtaatgcctacccgctactttcgctcatttgaattaaggtcctttcgtcatgcaaatttggggaacatacaaagagacaaagactagggaccactatttctacagttcccctcatgtctgagaatatgctgga

SEQ ID NO: 7528 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattcttacagttccctcatggtctgagaatatgctggga

SEQ ID NO: 7529 - DNA, 504 bp, Artificial
  TaSBEIIa allele with mutations introduced by TALEN pair TaSBEIIa_T02
  misc_feature (446): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgccaggcccacggcttgaccccccagcaggtggtggccaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagngacaaagactagggaccactattcttacagttccctcatggtctgagatatgctggga

SEQ ID NO: 7530 - DNA, 467 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccattcatacagatcccctcgtggtctgagaatatgctggga

SEQ ID NO: 7531 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactagggaccactatttcttacagttcccctcatggtctgagaatatgctggga

SEQ ID NO: 7532 - DNA, 472 bp, Artificial
  TaSBEIIa allele with mutations introduced by TALEN pair TaSBEIIa_T02
  misc_feature (449): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatacaaagaggacaaagactagggaccactattcatacagttcccctnactggtctgagaatatgctggga

SEQ ID NO: 7533 - DNA, 462 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcattttgaattaaggtcctttcgtcatgcaaatttgggaacatcaaagagacaaagactagggaccactattcttacagttccctcatggtctgagaatatgctggga

SEQ ID NO: 7534 - DNA, 468 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcatcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7535 - DNA, 490 bp, Artificial
  TaSBEIIa allele with mutations introduced by TALEN pair TaSBEIIa_T02
  misc_feature (459); (460): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaaatnngtgctgatcgcacgagacacaggaggtagg

SEQ ID NO: 7536 - DNA, 463 bp, Artificial
  TaSBEIIa allele with mutations introduced by TALEN pair TaSBEIIa_T02
  misc_feature (403): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaccaggagatgggcagaaaatatacgagattgacccaacgctgaaagattttcggagccatcttgactaccggtaatgcctacccgctactttcgctcattttgaattaaggtccttcgtcatgcaaatttggggaacatcaaagngacaaagactagggaccactattcttacagttcccctcatggtctgagaatatgctggga

SEQ ID NO: 7537 - DNA, 496 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggtggaggcagtgcatgcatggcgcaatgcactgacgggtgcccgctaaacaatcactgatggtgtaaccaaaggagttaaggaactagtcgtgggggagaaaccgcgagttgtcccaaaaccaggagatgggcagaaatatacgagattgacccaacgctgaaagattttcggagccatcttgactaccggtaatgcctacccgctactttcgctcatttgaattaaggtctttcgtcatgcaattggggaacatcaaagagacaaagactagggaccactattcttacagttcccctccatggt

SEQ ID NO: 7538 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctggga

SEQ ID NO: 7539 - DNA, 508 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcgtgtaaccaaaggagttaaggaactagtcgtgggggagaaaccgcgagttgtcccaaaaccaggagatgggcagaaaatatacgagattgacccaacgctgaaagatttcggagccatcttgactaccggtaatgcctacccgctactttcgactcatttgaattaaggtccttttccg

SEQ ID NO: 7540 - DNA, 471 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacagggggggactgcagagaaacttcaatcttcagaaccgactcagggcattgaacaatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7541 - DNA, 459 bp, Artificial; identical to SEQ ID NO: 7357
  TaSBEIIa allele with mutations introduced by TALEN pair TaSBEIIa_T02

SEQ ID NO: 7542 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7543 - DNA, 467 bp, Artificial; identical to SEQ ID NO: 7475
  TaSBEIIa allele with mutations introduced by TALEN pair TaSBEIIa_T02

SEQ ID NO: 7544 - DNA, 467 bp, Artificial
  TaSBEIIa allele with mutations introduced by TALEN pair TaSBEIIa_T02
  misc_feature (238); (444): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtggggganaaaccgcgagttgtcccaaaaaccaggagatgggcagaaaatatacgagattgacccaacgctgaaagattttcggagccatcttgactaccggtaatgcctacccgctactttcgctcattttgaattaaggtccttcgtcatgcaaatttgggaacatcaaagagacaaagactagggaccactatttcttacagttccccctnatggtctgagaatatgcgtggga

SEQ ID NO: 7545 - DNA, 465 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactatttctacagttcccctctatggtctgagaatatgctggga

SEQ ID NO: 7546 - DNA, 464 bp, Artificial
  TaSBEIIa allele with mutations introduced by TALEN pair TaSBEIIa_T02
  misc_feature (441): n is a or c or t or g
tcagatggatgtgcattctagcaagaacttcacgaaataatgcactgtttgtggtttcgttagtctgctctacaattgctatttttcgtgctgtagatacctgaagacatcgaggagcaaacggctgaagtaaacatgacaggggggactgcagaaaaacttgaatcttcagaaccgactcaaggcatatcactgatggtgtaaccaaaggagttaaggaactagtcggtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttgggaacatcaaagagacaaagactagggaccactatttcttacagttcccctnactggtctgagaatatgctggga

SEQ ID NO: 7547 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcattttgaattaaggtcctttgtcatgcaaatttgggaacatcaaagagacaaagactagggaccactatttcttacagttcccctcatggtctgagaatatgctggga

SEQ ID NO: 7548 - DNA, 459 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgatggtgtaaccaaaggagttaaggaactagtcgtgggggagaaaccgcgagttgtcccaaaaccaggagatgggcagaaaatatacgagattgacccaaacgctgaaagattttcggagccatcttgactaccggtaatgcctacccgctactttcgctcattttgaattaaggtcctttcgtcatgcaaatttggggaacatcaaagagacaaagactagggaccactattcttacagttcccctcatggtctgagaatatgctgga

SEQ ID NO: 7549 - DNA, 459 bp, Artificial
  TaSBEIIa allele with mutations introduced by TALEN pair TaSBEIIa_T02
  misc_feature (232): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcatttgaattaaggtcctttgtcatgcaaatttggggaacatcaaagagacaaagactagggaccactattcttacagttcccctcactaggtctgagaatatgctggga

SEQ ID NO: 7550 - DNA, 460 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactaggggaccactatttcttacagttcccctcatggtctgagaatatgctggga

SEQ ID NO: 7551 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcataggtctgagaatatgctggga

SEQ ID NO: 7552 - DNA, 445 bp, Artificial
  TaSBEIIa allele with mutations introduced by TALEN pair TaSBEIIa_T02
  misc_feature (218); (243): n is a or c or t or g
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattggagttaaggaactagtcgcggggganaaaccgcgagttgtcccaaaaaccnggagatgggcagaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactattcatacagttcccctcatggtctgagaatatgctggga

SEQ ID NO: 7553 - DNA, 464 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttgggaacatcaaagagacaaagactagggaccactatttcttacagttaccccctcatggtctgagaatatgctggga

SEQ ID NO: 7554 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgacacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaattttggggaacatcaaagagacaaagactagggaccactatttcttacagttcccctcatggtctgagaatatgctggga

SEQ ID NO: 7555 - DNA, 462 bp, Artificial
  TaSBEIIa allele with mutations introduced by TALEN pair TaSBEIIa_T02
  misc_feature (237): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcaacaatcactgatggtgtaaccaaaggagttaaggaactagtcgtggggganaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttgggaacatcaaagagacaaagactagggaccactattctacagttcccctcatggtctgagaatatgctggga

SEQ ID NO: 7556 - DNA, 508 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgccaggcccacggcttgaccccccagcaggtggtggccaaacaatcactgatggtgtaaccaaaggagttaaggaactagtcgtgggggagaaaccgcgagttgtcccaaaaccaggagatgggcagaaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7557 - DNA, 472 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcaattgacaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctaatttcgctcattttgaattaaggtcctttcatcatgcaaatttggggaacatcaaagaggcaaagactagggaccactatttcatacagttcccctcatggtctgagaatatgctggga

SEQ ID NO: 7558 - DNA, 522 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtgtcctgcgctggatgcagtgaaaaagggattgggggatcctatcagccgttcccagctggtgaagtccgagcggaaacaatcactgatggtgtaaccaaaggagttaaggaactagtcgtgggggagaaaccgcgagttgtcccaaaaccaggagatgggcagaaaatatacgagattgacccaacgctgaaagatttcggagccatcttgactaccggtaatgcctacccgctactttcgctcattttgaattaaggtcctttcgtcatgcaaatttggggaacatcaaaagagacaaagactagggaccactatttcttacagttccctc

SEQ ID NO: 7559 - DNA, 472 bp, Artificial; identical to SEQ ID NO: 7413
  TaSBEIIa allele with mutations introduced by TALEN pair TaSBEIIa_T02

SEQ ID NO: 7560 - DNA, 466 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattaatcactgatggtgtaaccaaaggagttaaggaactagtcgtggggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7561 - DNA, 507 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgtggtggaggcagtgcatgcatggcgcaatgcactgacgggtgcccgctaaacaatcactgatggtgtaaccaaaggagttaaggaactagtcgtgggggagaaaccgcgagttgtcccaaaaccaggagatgggcagaaatatacgagattgacccaacgctgaaagattttcggagccatcttgactaccggtaatgcctacccgctacttcgctcatttgattaagtcctttcgtcatgcaaattgggaacgatcaaagagacaaagactagggaccactatttcttacagttcccctcactaggtctgagaagtt

SEQ ID NO: 7562 - DNA, 451 bp, Artificial; identical to SEQ ID NO: 7270
  TaSBEIIa allele with mutations introduced by TALEN pair TaSBEIIa_T02

SEQ ID NO: 7563 - DNA, 464 bp, Artificial; identical to SEQ ID NO: 7308
  TaSBEIIa allele with mutations introduced by TALEN pair TaSBEIIa_T02
  misc_feature (237): n is a or c or t or g

SEQ ID NO: 7564 - DNA, 505 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccaggcgtgtaaccaaaggagttaaggaactagtcgtgggggagaaaccgcgagttgtcccaaaaccaggagatgggcagaaactatacgagattgacccaacgctgaaagattttcggagccatcttgactacggtaatcgcctacccgctacttcgctcatttgattaagtcctttccg

SEQ ID NO: 7565 - DNA, 450 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaccgctactttcgctcattttgaattaaggtcctttcgtcatgcaaatttggggaacatcaaagagacaaagactaggggaccactattcttacagttcccctcatggtctgagaatatgctggga

SEQ ID NO: 7566 - DNA, 464 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcataatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtatgcctaccgctaatttcgctcattttgaattaaggtcctttcatcatgcaaatttggggaacatcaaagagcaaagactagggaccactatttcatacagttcccctcatggtctgagaatatgctggga

SEQ ID NO: 7567 - DNA, 465 bp, Artificial; identical to SEQ ID NO: 7481
  TaSBEIIa allele with mutations introduced by TALEN pair TaSBEIIa_T02

SEQ ID NO: 7568 - DNA, 468 bp, Artificial; identical to SEQ ID NO: 7350
  TaSBEIIa allele with mutations introduced by TALEN pair TaSBEIIa_T02

SEQ ID NO: 7569 - DNA, 505 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgccaggcccacggcttgaccccccagcaggtggtggccaaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcattttgaattaagtcctttcgtcatgcaaatttggggaacatcaaagagacaaagactagggaccactatttcttacagttcccctcatggtctgagaatatgctggga

SEQ ID NO: 7570 - DNA, 463 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattcaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctacttcgctcattttgaattaaggtcctttcgtcatgcaaatttgggaacatcaaagagacaaagactagggaccactattcttacagttcccctcatggtctgagaatatgctggga

SEQ ID NO: 7571 - DNA, 468 bp, Artificial
  TaSBEIIa allele with mutations introduced by TALEN pair TaSBEIIa_T02
tcagatggatgtgcattactagcaagaacttcaacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctaacccgctactttcgctcattttgaattaaggtcctttcgtcatgcaaatttgggaacatcaaagagacaaagactagggaccactatttcttacagttcccctcatggtctgagaatatgctggga

SEQ ID NO: 7572 - DNA, 464 bp, Artificial; identical to SEQ ID NO: 7441
  TaSBEIIa allele with mutations introduced by TALEN pair TaSBEIIa_T02

SEQ ID NO: 7573 - DNA, 466 bp, Artificial; identical to SEQ ID NO: 7345
  TaSBEIIa allele with mutations introduced by TALEN pair TaSBEIIa_T02

SEQ ID NO: 7574 - DNA, 518 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgacacacgcgcacatcgttgcgttaagccaacacccggcagcgttatcggatcccgggccaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcatttgaattaaggtcctttcgtcatgcaaatttggggaacatcaaagagacaaagactagggaccactattcttacagttcccctcatggtctgagtaat

SEQ ID NO: 7575 - DNA, 466 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattacaatcactgatggtgtaaccaaaggagttaaggaactagtcgtgggggagaaaccgcgagttgtcccaaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactaggacaccatttcatacagatcccctcgtggtctgagatatgctggga

SEQ ID NO: 7576 - DNA, 465 bp, Artificial; identical to SEQ ID NO: 7542
  TaSBEIIa allele with mutations introduced by TALEN pair TaSBEIIa_T02

SEQ ID NO: 7577 - DNA, 470 bp, Artificial; identical to SEQ ID NO: 7331
  TaSBEIIa allele with mutations introduced by TALEN pair TaSBEIIa_T02

SEQ ID NO: 7578 - DNA, 468 bp, Artificial
  TaSBEIIa allele with mutations introduced by TALEN pair TaSBEIIa_T02
  misc_feature (301): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattaaacaatcactgatggtgtaaccaaaggagttaaggaactagtcgtgggggagaaaccgcgagttgtcccaaaaccaggagatgggcagaaaatatacgagattgacccaanactgaaagattttcggagccatcttgactaccggtaatgcctaccgctgctttcgctcattttgaattaaggtcctttcatcatgcaaatttggggaacatcaaagagacaaagactagggaccaccatttcatacagatcccctcgtgtctgagaatatgctggga

SEQ ID NO: 7579 - DNA, 507 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggggactgcagaaaaacttgaatcttcagaaccgactcaaggcatagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcgtgtaaccaaaggagttaaggaactagtcgtgggggagaaaccgcgagttgtcccaaaaccaggagatggggcagaaaatatacgagattgacccaacgctgaaagattttcggagccatcttgactaccggtaatgcctacccgctacttcgctcatttgaattaggtccttttcg

SEQ ID NO: 7580 - DNA, 458 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcactgatggtgtaaccaaaggagttaaggaactagtcgtggggagaaaccgcgagttgtacccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7581 - DNA, 508 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcattgccaggcccacggcttgaccccccagcaggtggtggccaaacaatcactgatggtgtaaccaaaggagttaaggaactagtcgtgggggagaaaccgcgagttgtcccaaaaccaggagatgggcagaaaatatacgagattgacccaacgctagaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7582 - DNA, 470 bp, Artificial
  TaSBEIIa allele with mutations introduced by TALEN pair TaSBEIIa_T02
tcagatggatgtgcattctagcaagaacttcacaaaataatgcactgtttgtggtttcgtttgtctgctctacgattgctatttttcgtgtgctgtagatacctgaagatatcgaggagcaaacggctgaagtgaacatgacaggggggaccgcagagaaacttgaatcttcagaaccgactcagggcattgcaatcactgatggtgtaaccaaaggagttaaggaactagtcgcgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7583 - DNA, 452 bp, Artificial
  TaSBEIIa allele with mutations introduced by TALEN pair TaSBEIIa_T02
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaacaatcactgatggtgtaaccaaaggagttaaggaactagtcgtgggggagaaaccgcgagttgtcccaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacacgttcccctcatggtctgagaatatgctggga

SEQ ID NO: 7584 - DNA, 468 bp, Artificial
  TaSBEIIa allele with mutations introduced by TALEN pair TaSBEIIa_T02
  misc_feature (299): n is a or c or t or g
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcattacaatcactgatggtgtaaccaaaggagttaaggaactagtcgtgggggagaaaccgcgagttgtcccaaaaccaggagatgggcagaaaatatacgagattgacccaanactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7585 - DNA, 510 bp, Artificial
  TaSBEIIa allele with mutations introduced by TALEN pair TaSBEIIa_T02
  misc_feature (495): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacagggggggactgcagaaaaacttgaatcttcagaaccgactcaaggcatttaccccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcacccctgacccctggaggaggtgaggaggaagttcaacaacggcgagatcaacttcgcggccgactgataactcgagaagggcgcgataacaatcactgatggtgtaaccaaaggagttaaggactagtcgtggggagaacgngagtgtaccaaaccg

SEQ ID NO: 7586 - DNA, 464 bp, Artificial
  TaSBEIIa allele with mutations introduced by TALEN pair TaSBEIIa_T02
  misc_feature (235): n is a or c or t or g
tcagatggatgtgcattctagcaagaacttcacgaaataatgcactgtttgtggtttcgttagtctgctctacaattgctattttcgtgctgtagatacctgaagacatcgaggagcaaacggctgaagtaaacatgacaggggggactgcagaaaaacttgaatcttcagaaccgactcaaggcatatcactgatggtgtaaccaaaggagttaaggaactagtcgtggggganaaaccgcgagttgtcccaaaaaccaggagatgggcagaaaatatacgagattgacccaacgctgaaagattttcggagccatcttgactaccggtaatgcctacccgctactttcgctcattttgaattaaggtcctttcgtcatgcaaatttggggaacatcaaagagacaaagactagggaccactatttcttacagttcccctcatggtctgagaatatgctggga

SEQ ID NO: 7587 - DNA, 462 bp, Artificial
  TaSBEIIa allele with mutations introduced by TALEN pair TaSBEIIa_T02
tcagatggatgtgcattctagcaagaacttcacaacataatgcaccgtttggggtttcgtcagtctgctctacaattgctatttttcgtgctgtagatacctgaagatatcgaggagcaaacggcggaagtgaacatgacaggggggactgcagagaaacttcaatcttcagaaccgactcagggcatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctacccgctgctttcgctcattttgaattaaggtcctttcatcatgcaaatttggggaacatcaaagagacaaagactagggaccaccatttcatacagatcccctcgtggtctgagaatatgctggga

SEQ ID NO: 7588 - DNA, 467 bp, Artificial
  TaSBEIIa allele with mutations introduced by TALEN pair TaSBEIIa_T02
tcagatggatgtgcattctaagcaagaacttcacaacataatgcaccgtttgggggtttcgtcagtctgctctacaattgctatttttcgtgctgtagatacctgaagatatcgaggagcaaacggcggaagtgaacatgacaggggggactgcagagaaacttcaatcttcagaaccgactcagggcattgatcactgatggtgtaaccaaaggagttaaggaactagtcgtgggggagaaaccgcgagttgtcccaaaaccaggagatgggcagaaaatatacgagattgacccaacactgaaagattttcggagccatcttgactaccggtaatgcctaccgctgctttcgctcattttgaattaaggtcctttcattcatgcaaatttggggaacatcaaagagacaaagactagggaccaccatttcatacagatcccctgtggtctgagaatatgctggga

SEQ ID NO: 7589 - DNA, 458 bp, Artificial; identical to SEQ ID NO: 7407
  TaSBEIIa allele with mutations introduced by TALEN pair TaSBEIIa_T02

SEQ ID NO: 7590 - DNA, 468 bp, Artificial; identical to SEQ ID NO: 7374
  TaSBEIIa allele with mutations introduced by TALEN pair TaSBEIIa_T02

(The sequence listing continues in the following parts.)

What is claimed is:

1. A hexaploid *Triticum* plant, plant part, or plant cell comprising at least three deletion or insertion mutations induced by contact with a transcription activator-like effector (TALE) nuclease configured to bind a nucleic acid sequence as set forth in SEQ ID NO: 8,
wherein the at least three deletion or insertion mutations are within the binding site of the TALE nuclease in at least three starch branching enzyme IIa (SBEIIa) alleles endogenous to the plant, plant part, or plant cell, in each genome,
wherein each starch branching enzyme IIb (SBEIIb) allele of the hexaploid *Triticum* plant, plant part, or plant cell is a wild-type SBEIIb allele, and wherein the *Triticum* plant, plant part or plant cell has increased levels of dietary fiber as compared to a control hexaploid *Triticum* plant in which the SBEIIa alleles have not been mutated, and
wherein the mutant SBEIIa alleles comprise the sequences set forth in SEQ ID NO:11910, 11912, and 11915, respectively, or the sequences set forth in SEQ ID NO:11910, 11913, and 11915, respectively, wherein the plant, plant part, or plant cell contains an A, B, and D genome and the mutations are homozygous mutations in the SBEIIa-A, B and D alleles.

2. The plant, plant part, or plant cell of claim 1, wherein the at least three induced deletion or insertion mutations comprise a deletion of one or more nucleotide base pairs in each of the at least three SBEIIa alleles.

3. The plant, plant part, or plant cell of claim 1, wherein the at least three induced deletion or insertion mutations comprise an insertion of one or more nucleotide base pairs endogenous to the plant, plant part, or plant cell in each of the at least three SBEIIa alleles.

4. The plant, plant part, or plant cell of claim 1, wherein every endogenous SBEIIa allele comprises the deletion or insertion induced by the TALE nuclease configured to bind to SEQ ID NO: 8.

5. A *Triticum* plant, plant part, or plant cell comprising mutations within three starch branching enzyme IIa (SBEIIa) homoeoalleles endogenous to the plant, plant part, or plant cell, wherein the mutant SBEIIa homoeoalleles comprise the sequences set forth in SEQ ID NO:11910, 11912, and 11915, respectively, or the sequences set forth in SEQ ID NO:11910, 11913, and 11915, respectively, and wherein the *Triticum* plant, plant part or plant cell has increased levels of dietary fiber as compared to a control hexaploid *Triticum* plant in which the SBEIIa alleles are wild-type, wherein the plant, plant part, or plant cell contains an A, B, and D genome and the mutations are homozygous mutations in the SBEIIa-A, B and D alleles.

6. The plant, plant part, or plant cell of claim 1, wherein each of the genomes exhibit removal of an endogenous nucleic acid of the at least three SBEIIa alleles and do not include any exogenous nucleic acid in the at least three SBEIIa alleles.

7. The plant, plant part, or plant cell of claim 1, wherein the plant part is grain.

8. The plant, plant part, or plant cell of claim 7, wherein the grain is milled, ground, pearled, rolled, kibbled, parboiled, or cracked grain.

9. The plant, plant part, or plant cell of claim 1, wherein the hexaploid *Triticum* plant, plant part, or plant cell is of the species *Triticum aestivum*.

10. A method for generating a *Triticum* plant that has increased levels of dietary fiber, wherein the method comprises:
(a) contacting a hexaploid *Triticum* plant cell or plant part comprising functional SBEII alleles with a TALE nuclease configured to bind to a nucleic acid sequence as set forth in SEQ ID NO: 8;
(b) selecting from the plant cell or plant part a plant cell or plant part in which at least one SBEIIa allele in each genome of the plant cell or plant part comprises a deletion or insertion mutation within the binding site of the TALE nuclease and each SBEIIb allele is a wild-type SBEIIb allele; and
(c) growing the selected plant cell or plant part into a *Triticum* plant, wherein the *Triticum* plant has increased levels of dietary fiber as compared to a control hexaploid *Triticum* plant in which the SBEIIa alleles have not been mutated, wherein the mutant SBEIIa alleles comprise the sequences set forth in SEQ ID NO:11910, 11912, and 11915, respectively, or the sequences set forth in SEQ ID NO:11910, 11913, and 11915, respectively, and wherein the selected plant cell or plant part contains an A, B, and D genome and the mutations are homozygous mutations in the SBEIIa-A, B and D alleles.

11. The method of claim 10, wherein the hexaploid *Triticum* plant cell is a protoplast.

12. The method of claim 11, wherein the contacting comprises transforming the protoplast with a nucleic acid encoding the TALE nuclease.

13. The method of claim 12, wherein the nucleic acid is an mRNA.

14. The method of claim 12, wherein the nucleic acid is contained within a vector.

15. The method of claim 11, further comprising culturing the protoplast to generate a plant line.

16. The method of claim 11, further comprising isolating genomic DNA comprising at least a portion of the at least one SBEIIa allele from the protoplast.

17. The method of claim 10, wherein the hexaploid *Triticum* plant part is an immature embryo, embryogenic callus, or scutella.

18. The method of claim 17, wherein the contacting comprises transforming the immature embryo, embryogenic callus, or scutella with a nucleic acid encoding the TALE nuclease.

19. The method of claim 18, wherein the transforming comprises *Agrobacterium*-mediated transformation or biolistics.

20. The method of claim 17, further comprising culturing the immature embryo, embryogenic callus, or scutella to generate a plant line.

21. The method of claim 17, further comprising isolating genomic DNA comprising at least a portion of the at least one SBEIIa allele from the immature embryo, embryogenic callus, or scutella.

22. The method of claim 10, wherein the *Triticum* plant cell or plant part is of the species *Triticum aestivum*.

23. The plant, plant part, or plant cell of claim 1, wherein the plant, plant part, or plant cell comprises an A, B and D genome and the SBEIIa-A allele comprises a deletion at position 539 of SEQ ID NO:1.

24. The plant, plant part, or plant cell of claim 23, wherein the plant, plant part, or plant cell further comprises a SBEIIa-B allele comprising a deletion at position 813 of SEQ ID NO: 5081.

25. The plant, plant part, or plant cell of claim 23, wherein the plant, plant part, or plant cell further comprises a SBEIIa-D allele comprising a deletion at position 811 of SEQ ID NO: 5082.

26. The plant, plant part, or plant cell of claim 25, wherein the plant, plant part, or plant cell further comprises a SBEIIa-B allele comprising a deletion at position 813 of SEQ ID NO: 5081.

27. The method of claim 10, further comprising selfing the grown *Triticum* plant to generate a plant line homozygous for the mutant SBEIIa alleles.

28. The plant, plant part, or plant cell of claim 7, wherein the grain has a starch content that includes at least 40% (w/w) amylose.

29. The plant, plant part, or plant cell of claim 7, wherein the grain has an increased amount of total protein compared with a control grain of a hexaploid *Triticum* plant in which the SBEIIa alleles have not been mutated.

* * * * *